United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 18

SEQ ID NO: 31 - DNA, 3224902 bp, Butyricicoccus faecihominis (residues 1,612,452-3,224,902 of 3,224,902)
  misc_feature (2450458)..(2450459): ">" designating noncontiguous sequence of whole genome
  misc_feature (2464520)..(2464521): ">" designating noncontiguous sequence of whole genome
  misc_feature (3151483)..(3151484): ">" designating noncontiguous sequence of whole genome
  misc_feature (3213402)..(3213403): ">" designating noncontiguous sequence of whole genome
tgcacgagtgcgcgggtgcaggattccatctcggcgatggagttggtctccataatgcgcttgagcgaggaaatgctgccgccctcgagcgaatgtccggccattccgggaaactgcagctccataccgaactggtgaatatatacgcagatattgcgcacggtatccggcggcagcttgttgctgtccgcataggcgaaaatgcagtcgagcagctgctctgtgtcggcgggattacgcagctccatcgcagatttaagggcagagagcatttcaaagatttcgtcggtcagctgctgcgggaacgagctgagctcagcgaagtgcgtcaccggatggtcgggcgtgaagacggtgaagcgcaccgcctgtgcggcttcatcggcggcgtcggcaagacagatgggattgtcattgcagttggaaataccgataaacagcagaaaatgtgccagactgccgacaatattcaccgcttccctgcataatgcggtaatgggcgcttccccggcggcacagatgaccacaaagcagtcctgcgtgccgcgggcaatgtagtaatgctggtaggaggatagacagtcggacagaatctcctgcgactggttgagatactcgttgtattcttcctcggtcagcgcttcctcggacagcgaggtaatatgcagcttgagtacaaaatagctgcgcaggtccattttcagctgagccaagcggttgagcacatacagctgcgagcatgcaacacggtggatgaggtcatgcagcagcatgctctgctgcagctctatgttgcgcgccgaggtcgtggagagcttctcctgcagatcctgactgctgcggtcttccgctatggcggccttggctttttcgatggcattggtcaggttttctaccgtcatcggcttgagtacaaaatccaccacatgatactggatggcacgctgcgcgtaggcaaaatccggatagccggtcaaaatgatgactttgatgccgggatagtcgcgggcgatgatctcggcaagctcaagaccgtccataccgggcatgcggatatcgctgataacgatattcggctgaatgaccggaatctgctcgagcgccatcatgccgtcgtctgcctgtgcggcaatctcacagctgaggtcgccccagtggatgcagtgtaccagacccttgcggatggcggattcattgtcaacgatcataactttcagcataggtctttctccttttcgggcggtgcggtgatgatggggagcgtcagcacgatgctcgtgccgtgtccgggttcggatttgatcgacatgccgtagggctcgccgtacagcagctgaaaacggcgctcgatgttgtgcagcgcaacatgtgtgtggtgcttgtcgtcgctgccgggctgggggatggcggacgggtcaaagcctacgccgtcatcgtgcacgcggatgtacacggcgtcctcctcctcccagatgctgacgcgcacccagccgccgtgacgcttgggttcgagtccgtgcacgatactgttttctaccagcggctgaatggtcagcttaggcaggtagcagccgagcagcttgtcgtcctccacatcgacggtatactgcagcttttcctcaaagcgttccttttgcagggcaagatagtattttaccgaatccagctcctcctgcagggtgataatctgcttgccatggttgacaacgcttgcccgcagcagctgcgccagattctgcaccgtggtgcagatggccggctgaccggctaccatgcagcggacattgatcagctcgagaatattaaagatgaagtgcggctgaatctggctctccagctgatgaatctctgcatcgcgcagcagcagaccgcgctgatagacctcctgaaacagggtgtccagccggtcggccatgtcgttgaaggcatgcgagatagcggtcgtttcggtgtatggcgtttcatccatgcgcacggaaaaatcaccgctgccgatactgccgatggtatgcagcatctgccgcagaggacgcagcagcaggatgagacaggtggcggccagcagcagggccagaatcaggatggcagcacagacgagaaaatacacacgcgtactctggcgcacaccggtgaggatttcggcgtttggaatatagatatccacgcgctcacggctttttcggagtgagctggacgcatgataccacttgttcatatcctcgttctcgcggaacaggtcggtctgcagagagccgatgcgtttgccctgagcaccgctgaaaatgacgacagtggaagggtaaagctggttcagcgacagcgtggagagcagcttgtcgatgttcagctccacgatgattttgccaagcggctgcatggtgttgaggtcaacaaaatcgacgatcatatatgcgtatccaatgatggtgtagtgcgtgtacagcgtgcgtgcggagttgcagtcctcgtgcgtctggtacatctgtcggacgcgccacgaggtattcaaatagtagttgccgccgtagaccggcacatattggtcgtttttgatcaggtagatggcgctgaccacatcggggttgagcgaatcgccgagcgagaatgcgcggctgaaattctgctccagccggagaatctggatctgggtgagcggtttgctgctgctcatcatctgctgggcggcacggtctgaggtcaggtagtacacaccatcccgcagggtctccatcatgcggtcggtgcggtcggtgaattcgttcagatacatggaaaccgtctcactggcggtatgctgcagctgaccggatacggtatggataaaatagatgccggcggtgacaacaggtgcgaataccagaacacatatcatcacaacgaccagcccgataagagagatcttgcgttttgccatacaatacacctcacgggagattctgcgaatcatacaaaggcaacaccatacaatggagctgcggagttaccctaaatataccacaattcgaccgctttgtgtaccatccggagggggagaagcgacattagaaaaaaatatcctgttttggcgcaaaataatcctatgttttcaaagaggagtgcagagcgtgtgaacgaaaagcaaaatcgtcatatgttttgaccggtttactgcattgagggcagactgttcctcgggtataataaatacaacaaaacacagagcggtatttgaatgagacaaatgccgtaaggagagaaagaggaggaaccccacatgaaaacaaagcgtatcctctccctgctgatggcaggtgcgctgctgaccggtgcactgaccggctgcggcagcaagaaggatgattctgcacagagcggtgacagctccggtgtgatcaccatcaactatccgacagcccagtgcggcacgaatacgtccgctccggtatgcgatgaactgattaaggaattcaatgagaagtacgcaggcaagtacgagatcaagaaggaagacgttccgggcgatcagaactacatcgacaagatcaaggtacagcttggcacgggcgatctcccgccggttatttacggcggcggctacaatctgcttgatatggtcgttgccaaggatctggcagttgacctgaccgatgcggtaaattccgatgcagactggaaggcactgtattcggataccgcgctggctaccaacagccgcgacggcaagatttacgcttcctcgatggaaggccaggttatcggttacttctacaacaaggacctgtttaagcaggcaggcatcaccgagccggctaagacctgggatgagttcttccagcagtgcgacaagctgaaggcagccggcatcaccccgctgtccatggataccgcagattctgcgtgggtaacccagctgtggatgggcgctatggtcggcaccgagtccgacgcaggccttgagttcatgaacaccatgaacccgaccgactacaacacgccggaaatgatcgcagcagccgagaagatccagaagatgtaccagaactacaccacgcaggatgcaatcggcggcaagtatgagaatgctgcaaacaacttcctatccggccagaccgcaatgctggcaaacggcccgtggatgatcggtgatttctctgatacctccatgacagaggaaggcttcgctgataaggtcggcgtagcgctgttcccgggcaacttcgtatacgatgcaccgattcagggctacatcgttaccaagcaggacgacccgaaggtagaagaggctgccattgagatggtcaagttctttacctcggctgaggcacagcagaccgcaatggagatgcagggcatggttccggcctccaacacggtagagctgaccgacaccgcaaaggacaagtatccgctgcttgctgagttccttgaccttgcaaccactgagggcgaaaagcgctcggatactctgcaggctacgatgtacgccaacctgctcgacgttatgagccagcagctcccgctgctcgcttcgggtgagctggacgcaaagggcttctgccagacgctgacggacgctgcagcgaagaaccagtaaactgtttaacgcagggacccgtcaaaaaacgggtccctttgctgtcgcgaaactgtagtttcgccgacaggcaggaacggaccgtgggccgttccaaagtcgtccgaaagttcctgtacagaaactttctccctccagaagtgtaaaaaatgagatacatgctcccgttttttacgaatttgcacagcaaattctatttcatgcgcgctgccgcgcgaatcggcggaagacgcagaaatatcaattttttcctcgcgataagaaaggaaaccgctttatgaaacgtaaaaagggctggctgccggtgttcctgcttccggctgtcgcattgttcctgctgatctatgctgttccgctggtgatcgtgtttgtttcctcgctgtttgattaccggttgacgggcgactcgatgacattcatcggtctgcagaactatacacagctgttcagcgatgcgaccttccggcaggcgtgcggccacacggtcgtctggattttgatccactgtattattcatgtctccatcggcgttatcctggcgcttgtgctgtacaaaaagccgcgcggctggaaatttgtccgtacggcatacatgatcccgaatatcatctccaacgccgcaatgggcatgatcttcctcaatattttcaacccgcagtacggcgtggtaaattccatcctcaaggctgttggtctggaaagcctgacgcataactggctgatggataccacaacggcgttcccgtccgttaccatgacgtggctgctgtttgcgggctacaccacgacgctcgtgctcgccgaggcgctgaccattgacgattcggtgctcgaagcggcccgtgtggacggtgcgacctcgttccagaccgatatgttcgttgtgctgccgctgctgcgcaagatcatcggcacgaccatggtcatggcggcaacctatatgctgcagatgttcgacctgatctacatcaccaccaagggcggccccggctcgactaccatgaacctgccgctcatgctgtacagcgtgtacaagaacgaaaacaactacggctactcgaatgcgatcggcgtttgcatcgtcatcgcgggtgtcgtttgcatgacgctcatcaacaaggcgatgcgcgtcaacgaagaagactactaaggaggcgttcgacaaatgaaaaccagcttcggtgcaatgaccggcagagaacgcctgtgctttgtgctcaaatatttgtttatggcgctgtgcgtggtcgttgcgctgttcccaatcatctgggtcatcctgtcctcgttcaagacgaatgcggagatcctgtcgaacggcatttcgctgccgacgcacttcgggtttgacggctataaatccgcactggatatggcgccgatcttcaagttcttcggcaacagcgtgatcgtcacctgctgcgcgacggtactcaatgtgctcgtcttcgctatggcaggctacgcgtttgcgcggttccgctttccgtgcgataagctgctgtacatgctgctcagcctgtcgctcgtcatcccgatgacggcactgttgcagccggtgtacagcgtggtcaacaatctgggtctgtatgataccaaggcgggtctgattctggtcaacaccgcactgaatatgccgatgagcctgctcatcctgcgcggtgcctttcagtctatccccaaggccattgaggaggccgcctacatcgacggtgcgggcttcctgcgcacgttcttccagatcatgatgccgtgcgccaagggcggtcttacgagcgcagctgtgctgtgcttcctcaatacatggaacgaatttacgttctccctgatcctgaccagcagcgagagtgcccgcacgctgccgctgtcgctcagctactttaccagccagttcagctttaactacacggcgctgtttgccgcagttaccattgcggtcattccttcgatcattgtgtttgcgatcttccaggagcaggtcgtttccagcctgaccgcgggttcggtcaaagaataaacgaggtgaaattacatggcaagcattagtttgaatcacatcaagaaggtgtaccccggtgatatcgaggttatctccgacctgaacctgcagatcaaggataaggagttcgtcgtactggtcggaccgtccggctgcggcaaatcgaccacactgcgcatgatcgcgggtctggaggagatttcggacggcgaaatgtacatcggtgaccgcaaggtgaacgatgtagcgccgaaggaccgcgatatcgcgatggttttccagaactacgcgctctatccgcatatgacggtttacaagaacatggcattcgcgctcaagctgcgaaaaacacctaaggacgaaatcgaccgcaaggtgcacgaggcggctaaggtgctggatatcgagcatctgctcaaccgcaagcccaagcagctttccggcggccagcggcagcgtgtcgcgctcggacgtgcgatggtgcgcgacccggcggtattcctgctcgatgagccgctgtccaatctggatgccaagctgcgcacccagatgcgcaccgagatcatcaagctgcatcagaagctggatacgacctttgtttacgtcacgcatgaccagaccgaggccatgaccatgggcgaccgtattgttgttatgaagggcggcgagattcagcaggcggacacaccgcagacgctgtatgaccatccgtgcaatctgttcgtagcgggcttcattggttcgccgcagatgaatttcatggacgccgagctgggacgcgatgcggacggctacaagctgaccttcgcggaccagagcctgcactttgcgggcagcgatgcgctgagtgagtacgttggaaagacggtcgtgttcggcatccgtccggagaatctgcacacctcgggtgaaaagtttacgcagaatgcggcgcatacgctcaccatgcatgtggatattgccgagctgatgggcgcggagatttacgcgcactgcacctgtgacggcacgtccgtgaccgtgcgtacgccgtccggcgagccgattcatgcgggcgacaccatcaccgcggctgtggatatgagccgcatccatttgttcgataagcagaccgaacgcgcgatcgcgttctgacaggaggaaaatctgtgtttcgtccatcctatttgaaggaaggtccgggcgttgccaaggatgcaccggaaaaaaccggcgctgcatgggtcggagagacccttgcgcgggagttctggcagctcgtcaagctgaatgtactgtttctgctgtgctgtctgccggtcgtgaccttcggtgcggctcgagccgccatggcgcgctgcacggtcaatatggcgcgtgatgtgccgaacgacgtgtggaccgatttccgtgcggcgctgcggcaggatacggtgcgcaatcttctgtgcggactggccgagcttgcgctgctgtggatgggcgtgatgctggtaacggcggacggatttttcccggcgctgctgggcatgctgctgctctgcgtcacggctgcgtttttccagaatttctgggcagtacaggcggcggtggacatcccgtttgcggcagcggcaaaaaatgcgtggctgctgtgtctgctccgtcccggcatgaccgtgctggggctgggcgtaaatgcgctgctgctgattcctgcagtgctgtttttcccgctttctctgccgtatgtgctgctgttcccgtgcggtctgtccggatttgcctcgggcatgatcggctggtccagctgcaaacggtatctgattcgataacaggaggtatctttttatgaaattaacggtaatcggcggcggcggtgtacgctccatgttcctcgcaaagagcattgcgcagcgtgcggaggagctgcacatcgacgagctggtatttatggataacgatccggaaaagctccgcatctacggcggtctggcggcacacgttgcgcgtatgctgtgcccgaccatgaagttcacgctgacctccagtgcggaggaggcggtaaccgatgcggattacgtcatcacgaccatccgtgtcggcggcgacgcgactcgcgtgcgcgatgaacgactggcgcttgatctgggtattctcggtcaggaaacgaccggcgctgccggcgtttcgtttgccatgcgctcgattccggcgctggctgaatactgcgagctgatcaaaaagctggcaaagccgggcgtcaaggtattcaacttcaccaatccggcaggcgtggtttcgcaggcactgcgcgatatgggctacgacttcacctacggtatctgcgacgcaccgagcggcatgctgcaccagtttgccgacctgtacggcgtggatgcgtcccgcatttacggcgaatgctacggtttgaaccatctgtcctacttccagagcatcaaggtggacggaaaggagattatgcccgagttgatcgccaatgacgaggcttacgccaagaccgatatgcgctttttcgagaagcgtctgctcgaggaccgtggctgtgtgctgaatgaatatctgtactacttctactaccgtgaaaaggcggttgccaacattctgaacgccaagcagacgcgcggcgagatgatctgcgacatcaaccgccacatgaccgaggagctgtccaagatcgacatcgagaacgactttgaggcgggtctcaagtgctttgagaagtggtacggcatccgcgagaataactacatggccaatgagactggtattcaccgcgacaagccgtggacgtttgatgtgtattccaaggacgcgggcggctacgcaggcgttgcgctcaagttcatcgagattgcagcctccggcggcatgggcacgatgatcctgtgcgcaccgaacggcaatgccatcgagggcctcgagccgaccgatattatcgaggttacctgcgatatctcccgcgagggctgcaagccgcaccatatcgagaacattccggagagcaacctcgaaatgatccgccgcgtaaaatattacgaacgtctggcggcacgcggtatcgtcaaccgctccaggaaggatattaccgagtgcctgaccatgcacccgctggtcggctcttactcgctggcaagcaagctgaccgacgagtatatcaagctcaacgcgccgtatatcggggactggagggactgacgcatgtcgtttctcgcttcggtcggtgtgaccaatgtggatttgatgtatgtcggcatgccgcgcgtgccgcaggagggcgaggagatcttttcgcaggatttccgcgtgctgctcggcggcggtgcaccgggtacggcagtaaacgccgcccggctgggcattccgacccgtctggcgacctatctcggcagcgatctgttttccggctttgcccgcgcgcagtttgagcagaacggcgtttctccgtacaatctggcggcggagggcgagaccggtattccggtgaatgtcaccagtgccatgctcacgcccggtgaccgtacatttgcgacctactgcaagccgaccgccatcacggacgagctgctcgagcgggtatataccatgtctaagggcgctaagctggtgcagatgcaggagggctttttgccggtatatcgcaagctgcacgaggaaggcaccattctgattttcgacatgggatgggatgatgaactgagttttgagaaatacggcgattatctgcgtctggcggattactacacgccgaataccaaggaagcactcaagatcaccggcagggacacgccggaggaggcgctcctcgtaatggctgagtattttgagcacccgctggtcaagctggataaggacggctgtctcattctcgaggacggcaggccgcgtctgctgcgcaatattccggaattcacctgtaaggattccaccggtgcaggcgatgcgttccttgcaggactgatgtacggtctgtaccacggctatccgtttgcggattgtgtgcggttcggcaacatcacaggcggcaagagtgttaccggcgtaggctgcctgaccgagtatgtgcaggagagcgagctgctcgcgctgcgtgaaaagtataaggatttataagcgtttggaggctttttcgttatgagaatcattcgtgcaaaggattataaggacatgagccgcaaggcggcaaatatcatttccgcgcaggtcatcctcaagccggattccgtgctcggtcttgccaccggctcgtcgccgatcggcacatatgagcagctggtcaagtggtacgaaaagggcgatctggattttgcggatgtgactacggtcaatctggatgaatactacggcatgaagccggaaaacgaccagagctatcattatttcatgcacgaccacttttttgaccatgtgaacatcgacccatcgcgtatcaatctgccgaacggcatggagccggacgagaaaaaggagtgcgcccgctatgatgcggtgcttcgcagtgtgggcgatgtggatattcagctgctcggcatcggccgcaacggccatatcggcttcaacgagccggacaactgcttcgccaagggcacgcactgcgtggagctgaccgagtccaccatcgaggcaaacaagcgctttttcgccagcgaggatgaggtgccgcgccgtgcctactcgatgggcattcacaccatcatgactgcaaaaaaagtgctggtcgttgccagcggcgaggacaaggcgtgggctatccgtgaatcctgcttcggcccagtaacgcccaaggtgcccggttcgattctgcagctgcacaacgacgcgatcgttatcgcagatgaggcagctctcagcctgtgcggcgattttctctgattcctgatcataacggcggcggtaccgtgttttatcttaccgtgcggtaaatcaacagcattctgcggtaccgtcgttttgaaacccgaagtgcagttctgtctccttctgcgctttgggttttatgatttttcgcaagggaggtgcgatatggtgcgcgttaccgatatgacacacggtcgtccgatacggctgattctgctgttttcgctgccgctgatgctgggcagcgtgtttcagcagctgtatactatcgtggatacgatcatcatcggacgcggtgtcggcatgcaggcgctggcgtccatcggtgcggcggattggatcaactggctggttttatggggactgcagggctttacgcagggctttgcgattctcgcggcgcaggagttcggcgcgggcgcatacgaccggctgcgtcgtgtactggctatgatcgttaagctgtcgtgctggttcggcattgcggtgacgatcatcagtctgctgctggtaagacctctgctcacactgctgcacaccgatcctgcagtgttcggcggagcacagacatacttatatgtgcagttcggcggctcgctcatcatcattgcgtacaacatggcggcggccgtgctgcgctgtctgggcgacagcagaacaccgctgtttgcgattatcgcggcgagctttgctaatattgcgctcgacctgctgttcgtgatgggctttggctggggcattttcggagcttcgttcgcaaccgtgctggcgcagctgattgcgtttctgctgtgtctgcggtcgctgcggcggctgccgttcgtgcagctgacaaaggccgactggaagaccgaccccgccattctgctgcacctgtgccgcctcggcattccgaccggtctgcagatgagcatgatcacactgggcggcatggtgctgcagtccgtgctgaacggcttcggcgtggtgttcgtggcgggctatacggcggccaacaagctgtacggcatactcgaaagtgcatcggtggcgtttggctatgccatgacagcctacatggggcagaaccgcggtgcacgaaacgcggcacgcattgatgcaggcattcgggcggtactggtgctgtccgccgaatttacagccgccatcgtgacggctatgcttgttgcgggcaaaccgctgctgggactgtttctttcgaccgaggaggcgggcgcagcagatgcgctggcggtggcctatcagtatctcatggtgctgatggcatttttgtttgcgctgttcgtgctgcaggcatatcgctcctcactgcaggggttgggcgagatgactgtgccgacgctttccggctttgcggaaatgctcatgcgcatgggcgcggcgctcgtgctgccgaccttcatcgggcagagcggcgtattctttgcggaaggcgcagcatgggtgtgtgcggcagcgctcaatctggtatggtattatatgcggattggaaaaatcaagcgggatatgctgcaatagcaaaggttctggacagactgagacgctcaaccgctgtcataagtggttgagcgccttgcgaatgaacttgatgccattgcattcggaagagagcagatcaatctatcaatagccatgagatatcctgtttgaagcgtcaaatattgtgtggatattcagatggggataggcgcaaaccgtttgcacctatcctcgcgttttctgccgctcgtatatatatagtaagaaaaggaccggaatcttccttccttttgtttggtgaaaggtgtatttcgcgtgccacctccatctgggtgcgtccctcgaagaaccgtagccggatgatacggcgctcgcggtcgttcaggctgcgcatagcgtcccgcagagcaataccggccagccagttgtcgtccgtgtttttggtgtcgccgacctgatccatcacgcagaccgtgtccgtgccatcgtggaacaccggctcaaacagcgacaccgggtcgagtatcgcgtcgagcgcgaacacgacctcctctttcggcacgtccatcagcctggccagttccacgatgtccggctcacgctggtgctcgcggatgaacgcctccttggcctgcagagcgcggtacgccgtgtcgcgcaggctgcgcgagactcgcatggcactgttgtcgcgcaggtagcggcggatttcgccgatgatcatcggtacggcgtaggtggagaagcgtacgccgagttcggtattaaaattgtcgatggctttcatcaggccgatgcatccgacctgaaacaggtcgtccggcgattcgccgcggccctgaaaccgctgaacaacgctgagcaccagccgcagattgccgcgaatcagctcatcgcgtgcctgcttgtctccggcagcggattttttcaaaagctcgtccgtctttttggcggagagcaccggcagtcccgatgtattcacaccgcagatctcaacttttgtctgcataaaattccctcctgttggtcgtcactatgaggatactatctggattttccccgcggtcccgttcaaatataccgacgaaatattttgcatgggccggagattcgacaaatttcacgttcgccttgtgatatggaaccgagaaagcgttttgcgtccatcagaaattccctcttgtgggaatagggggaaagggtgtataataaattcaagagaatgcctgtttgcagcgccacactgcacacaggcgattgaaaacgaaggagaatgcaatatgtttgaaaatctgattgcagcactcaaggctgacaagcgcaagatcgtattcaccgaaggcccggacgctcgtatcctcgaagcggctgcacgcctgaagaaggacggcctgatggattccatcctggtcggcaatgttgacgaggtaaaggctgctgctgcaaagggcggcttcgatatcgagggcatggagatcatcgacccggctacctacccggagatggacgctatggtagctaagatggtagagcttcgcaagggcaagatgagcgaggaggactgccgcgctgcactgtccaagggcaactacttcggcaccatgctcgttaagatgggcaaggctgacgctctgctcggcggcgctacctactccaccgctgacaccgttcgtccggctctgcagctgatcaagaccaagccgggcgcacacctcgtaagctcctgctttattctggtccgcgagaaggacggcgtagaggagaagctggctatgggtgactgcgcgattaacatcgactatccggattctgttgacaaggaaggcaacgtaaccctgaagggcagccagaagctggctgaggttgcaatcgagaccgctaacaccgctaaggctttcggcatcgacccgaaggttgcagttctgtccttctccaccaagggctccggcaagggcggcacggttgctctgtcccgcgaggctaccgagttcgctaaggagatgaacccggagctggcgatcgacggcgagctgcagtttgacgctgctgtatccccggttgttgctgctaccaagtgcaagggctctccggttgcaggtcaggctaacaccttcatcttcccgtctatcgaggctggcaacatcggctacaagatcgctcagcgtctgggcggctacgctgcttacggcccgatcctgcagggtctgaacgcgccgatcaacgatctgtcccgcggctgcaacgctgacgaggtttaccagatggcgatcatcaccgctggcctgaagtaatttcagcacacacataattgcataagtaaggaatccgccgacgtgaaaattcaattgcgtcggcgggttttgctttttcggtggggagggaaggcgtatgaaacgaagaatcctgtttgctttgatagccgttctggtttgcgctggagcggcagcgtgctttacatcgtatgcaccggtgccggatacgacagaaattgcagacgtgatggtactccgtgttcatgcgggagatacggctgaggacatcaccgggcaggtcgatacgaacgccgtatgcgaactgctgccgcaaatcaaagcacgccgtctgccgagttatcatcgcggtattagcaaagactgctatcaaattcaggtggtatacggcggtaaaaccgtatgtttcagcctcggtgaaccgagttatgcgtatgaggtcacagaaagtatgtcgccgtgggtgcataagctgtccggcagcgagaaactgctcgcgctgcttgataaacaataaaagggaggaaccgacatgaaaaaacgaatcgtatttatcctgatcgccattctgatttgtgcaggcgcggcggcattcgtgtttgtgccgtacacgcctatgccggatgcggacagcttccagaatgtgagcatctggcggatagacggcagagaccagaccgaaattaccgatcaggtcgatcaaactgctctgcgggaggtactgacgcaggtgcaggcgagccgtgtgccgtacccgaagcacagcttttcgatggataaggtcagctacgaaatcgttgcggtgtacaacgatacgccgaccgtcctcgatatcggtgagatcagttttgtgtaccgcgattgggtacataatctggcgaacggcagcgaggttctcgagaaattggatgaaatttgcaatctgtaaaatttaatttgttgtaatagggcttctctgtggaacggcgggatgggggcatcccgccctacacgataccttctgccgaatggtttgaatatataaaccacaataaaacaacataccgtagggcggggtgacctcaccccgccgtttctttctgaattgcgctgaattgtaccttgcggatgcacagattttcggttacattcattttccattctcaattctccattttcaattatgcaaccgcaaacataaaacaaaaggactgcccctccggtcagtcctttttacagcagcgacagctgtccatccgcgagattgacgatcttcagtccgctctgctcagccatatgcacggtctgcgcggtaccgcccgaccgtccatcatagtaacagatgagccttgacgatgcatccaccataaaccggttgcgcgcggcaaagcacccggcgtgatagctccgcgagagcgcgtacaccttatctgcggcgagcaggcagcggttgaatcggcgtttccactcgagcggaaaccgatcggcctgtccgtcgaacggcacagcacacagcagctgcaccgggagtgcggcgcgcgcgcgcagaacagcttcggcggcccacagatcaaagccggtggacataccggagagaaaccgcgtgcagccgtcagcggcggcctctgcgaccgcagcatcgagtgcggcgaacagctcgcgcgcagcgggacagtcatcgttccggaacggcattttttcaattcggtagccggaaaaacagcaggtcaccggacgcagatccgccatgacacaccctccaatcagaacaaatgttctgtttttatcagtatacaatagatgaagccaaaacgcaagttgtaaatttgataaaaagctgatatgataagtacagcaaaatttaccgacacaggggagggacgcaatgaacggtcaaaaccgatggctatatctgatcaagcgcatggtttaccgcttttttgatgacggcattccgcagtctgcggcagagctttcgtattttctgctgttttccatgttcccgctgctgatgttcgtcaactccatgctcgcacagcttgatctgtcaatcgaggggatgcagccggtgctggaaatgctgccgaaaagcctgcagcagctcataggcggctatattcagcagctgaccggcacgccgtcgttcagcccgatgatcgtcggtctgggtctgacgctgtatttcctgtcccgcgcggtgcgctcaatgatgcgcacggtcaacgatatttaccacgttgaaatctcgcgcggcatggtcaaggacgtgctcatttcgttcggcattacggcgggctttcttgtttcggttgtgtgcagctttgtgctcgttgtcgccggacgaaccatcatccgcgttgtaccgaaatatctatcggtgccgccagctgtgatggacggactgcacgatgccagcttctgggtgatgatcgcgtttattttcgtgttcctcatgctgttcaacaaggtcgtgcccaatctgcaccttaggttccgtgaggtgtggccgggggcgctgttctcgctggtagcgtggattctggtctcgcttggattttcgttctatgtggacaatatggcgcggtattctgtgctgtacggctctctggcggcgattatcgtactgatgctgtggctgtatatcgtcagcatgatcctgctgatgggtccgcagctgaatcatacgctggtcgtgatgcggctgtaccggctggagaacgaaaagcatttataagtccaatattcgtcaaaaacagtgcggacgcgcactgaaaatagagaaaacacggaggaaaaggatatgaaagttgtagcaatcaacggctcgccgcgcaaggacggcaactgtgcgcagatgcttgaggtgctcggcaaggtgctcgagcaggagggcatcgagtttgaggtatgtcagcctggggcgaaggtgcatccgtgcatggcgtgctatcactgcctggacaacggcacgctgcgctgcgtgcaggacgacgacggtgtaaatgaaatcatcgccaagtgcattgaggcggacggcatcgtgctcgcgtctccggtgtaccacggcggcattgcgggcggtatgaagtgcgtgctcgaccgtctgattctggcggcaggctgcggcgataatcagctgaagcacaaggtcggtgcggcgctgtgtacgctgcgccgttcgggcggcatggaaacctatcagcagctgctcggcacgatcaacaccatggagatggtgcttgtcacctcggactactggaacgccgtacacggcgcagacaagggcgaggctgtgcaggatatcgagggcgttgaagtcatcgaaaagctgggccgcaatatcgcatggatgctcaaggtgatcgacaaggccggaatcgagccgccggaaagccgtccgcgcacgatgatgaactttatccgctgatccgtatggttatctactaaacaaaaattgcagagtccccaaaggcacaatgagaaactcattgtgcctttttgtgcataaatttatcaaattggtgggcatatcctgtgtaactgctgaaatgtgcgaaaaaattcacgaattgttaacggaactgtgcaaaaaatgtcatgtaaacgcgagtggattctgatacaataaatatatcacacaatgcagtcaaagggaggaatcatcatgacaccgaaacacgatattttacaggtcacgccgcgcgtggaagcgctggcggcgctctgccgctcgaacagccgcattgatccggcgctgtaccgcaagtacgatgtcaagcgtggtctgcgcgacatcaatggacagggcgtactggccggtctgaccaacatttcggacattatctcccgcaaggagataggcggcgaaatcgtgccctgtgagggtgagctgtactatcgcggcattcgcattcaggatctggtgcagggcttcatccgtgacggccgcaagggttatgaggaggttgcctatctgctgctgttcggtgagctgccggatgccaagcgtctgggcgacttcaaggcgctgctggcacagggccgcacgctgccgaccaatttcacccgcgatgtcatcatgaaagcgccgacgcacgatatgatgaacagcctgtcgcgcagtgtgctcacgctggcatcctacgacagcaacgcggatgatatcagcctgcccaacgtgctgcggcagtgcctgatgctgatttcggtctttccgatgctggcggtgtattcctatcacgcctacaatcactacgagtgcggcggcagcatgtacattcactacccgtcggacagtctgtctactgcgtccaacttcctgcgcatgctgcgcccggatatgcagtacacgccgctcgaggcaagcgtgctcgatctggcgcttgtgctgcacatggagcacggcggcggcaataattcgtcattcacaacacacgtcgtcacgtcctccggcacggatacctattcggctattgcagcggcgctcggttcgctgaaaggcccgaaacacggcggagcgaactacaaggtcgtgcagatgttcgaggatatgaagaaaaacgtgtcggataccacggatgagcaggcagtcgcggactatcttgtcaagctgctgcgccgtgaggcatttgaccagaagggactcatctatggcatgggccacgctgtgtactcgatatcggacccgcgtgcgcaggtgttcaaatccttcgtcggtcagctggcgcacgagaagggcagagacgcggatttcgcgctgtacaccatggtcgaggagatggcgcccaaggttatcgcgcaggaacgccacatctataagggcgtgtctgcaaatgttgatttttactcaggttttgtgtattccatgctgggtttgccgccggaattgtacacgccggtgttcgccatggcgcgtatcgtcggctggagcgcgcatcgcctggaggagctgatcaacacggataagatcatccgtccggcgtatcgctgcgtgcagcccgccgagccgtatgtggctcttaaagaaagataacgcagaacttcataaaataaagaacacaggcatcgcagagagagcagcggtgcctgtgttctttctatatggagcgtttagccgatgttgagtgcctcgcgcagcacctgcaggctggcgagatggccgtcgagcatggagagtgtcaaatcttccatttcaagggaaatctcatcgttgtagcccgacatgcggacaaccgagaaaaactccttccaccacttggcatcgtgtcccgcgccgacggcaacatagttccacgagcggcgggcaaatgcgtcgatcggcttggtatccagcatgccgtttggctgccagtagcggcgctccggccgtgaatccttgccgtggatatggtaaattgcaccgtgctcaccgagcacacgggctgcttcgatcggatcgccgcccatccagaacaggtgggacggatcaaggttcatgccgatcatcgggccgacagcctcacgcagacggagcagcgtttccgggttgtaaaccagctgcataccgtggttttcgagcgcaattcgctcgattccgcaatcctctgccagcttaacgagctttttccatgcgggaatcgcaacctgattccactggtaatccagaatgtcctgcgtctcgggcggccacgaggtcgtgatccacaccggcgttttatcgccctcgcagccgaccggcagaccgctcatcataacgatcttctttactccgagctgatgcgccagctcaaaggttttctttgttacatccatgtccttttcatacgcgagcgggttgcccgagcagttgagcgcgcacagctccagacccttctcacgcatggcatcataccatttttcgcgggcggtcttgtcgcttaccagaaggtcgaggtcacagtgcggcgcacccgaccagttgccggtgccgatttcaatggcggcaattttctgctccacgcagaagtcgagcatctgctcatagggcatatccagcgtgcaggttttgatagcaagcttcattgtcatattccttctctcattaggatacggtaattttaccacattgtaacctttgctggcaagagatgtctccaaaatatgcccaaaacgaccatgaaattcccatgattttataggaaaaatgccgtaagaaaaataaaaatgcacaatgcacagtgtctggttttcgattgtcaaagcaggaatttgtgaatgtgcacaaaacgaaacatgcgaaaatcaccacctcttacaaaaataacaacgaagggttgccaaaacggtattattgcattaaaatattaccagaacgttggagcgttcctaagtcccacagcagtgggaaccgaccgcagagcagacaatctgagagtctgtttgctccgcatgaaaaaggagagaggtttttatcatgaagaagagattacttgctatgctgatgactggcgctatggttgcaagccttgcagcttgcggcggcggttcttctaccccggctggcggcgacacccagaaggatggcggcgataaggctggcaccacttccggctgctctgttgacgttatcctgaagacgactgcttccgagtactggagctacgttaaggctggcgctgaggcttactccaaggacaacccggacgtaaaggttgaggttaagggcgctacctccgagaccgcttacgacgagcagcagaatatgatcgagaccgacctgaactctggcgcatacgatgcattcgttatcgctccgctgcaggctgacctcgttaagaccctgatcgctggccagaccgcaccgatcattgcagttgataccaacatcgatgcacctgaggttctgtccttcgtaggcaccggcaacgaggatgctgctgcaatgggcggcaaggctgctgttgaggctgctaaggctgctggctgggataaggttcaggcaatcgcaatttccggcgtacagggcgacggcactgctaccgcacgtctgaccggttatgagaagggcattaccgaggctggcggcgagttcctgaaggacgagatccagtacgctgacgctgttgctgataaggctgctacctcgatggaagcaatcatgcagaaccatccggacggcgtcgctatcatcgtctgcaacaacgacgatatggctatggctgctgctcgtgctgcaaagggcaacgctgcttacgcgaagaccatctttgttggcttcgacggcatccagtccgcttgcaacgctatcctggctggcgaggagaccatgtccgttgctcaggaagcatacgacatgggctacaaggcagttgatgctgctgtaaaggctgttaacggtgagaagctggagaagttcatcgactccggttgtgacgttatcaacaaggataacgctcagaagcgcctggataccctgaagggctacatcggctaagcaatccatcccacacgcttgtggttttccattagttccagcatttaagtgaacgagaagaaacccctgctcgatttcaatctctgcaggggttctcttttcaaacatgctcccgcggacaagaaatggtaaagagcttgcactgggcaggcttttccttagggaactgaaccgagaacagtttactttgtcccgcacttcatctcggagaagaaaaggtgatatgcaaatgagtgaatacgtagtagaactgaaaaacgcgaccaagcgttttccgggcgtagtggctctgaaaaacatgcagctttccgtcaagccgggcgagatcctcggcctgatcggtgagaacggcgcaggcaaatctacgctgatcaaggtgctgactggtgtacatcaggcagacgagggtcagatttatgtagacggcgtcgagcagcatttcaaggacccgaacgattcggcagcggctggcatcgcgtgcgtatatcaggagcttaacattgagaagctgctgagcattactgacaacattttcatcaacaagtggatcaaaaagggtactctgctggattacccgaccatgcataaaaaggcaaaggaagttatggcttcgctcggtcaggacgtagacccgaccaagccggcaggtaactttggtatgggcgtacagcagatgatcgagatcgcaaaggcggttctgatcaacgcaaaaatgattattatggacgagccgacctcctctctgggcgagaaagaggttgagcagctgatgaagacctgccgtgatctgaaggcacgcggcatcggcatcgtctttgtatcccataagctggaggagctgttcgagctgtgcgaccgcgttgaggttatccgtgacggtgagttcatcgcaaccaagccgatcgatcagtgggataatgactccctgatcaccgcaatggtaggtcgttcgctggacaaccagttcccgaaggaattcggcgaaaagtccaaggagccgatgctcgaggttgacaacgttgttgaggcaggcgtcctgaacgatgtatccttcaaggcatacggcggacagattctgggctttgcaggtctggtcggcgccggtcgtaccgagattatgcgcgcagtattcggcgcagatccgatcgatagcggcaagatcaagatcaagggcaaggaagtacatatcaagtccccgcgtcaggctatcaagcacggcattgcgttcctcaccgaggaccgtaagggacagggtctggtactggctcagaccattcgcaccaacctgattcttgctaacatgaagggcttctcttcgggcttgttcctgaacgaaaagaagatcctcgagacaggtgagcagaacattgcgtcgctgcgcatcaagaccccgtcgatcgacgagatcgtaggccagctgtccggtggtaaccagcagaaggtcgtaatcggcaaatgggtcaacacggatgcagagatctttatctttgacgaaccgacccgtggtatcgacgtcggcgcaaaggtcgaggtttacaacgtaatgaacagccttgtcaagcagggcaagtgcgttatcatggtatcttcggaaatgcctgagatcctcggcatgtccgaccgcgtaatcgtaatgcgcggcggcgaagtaatggccgaagtagaccgtgacagcgaacatttcaatcaggaagaccttatgaaggcagcttggggaggtaaattagatgactaaatcgaagaaatccagcagtttgatgtcttatgctggtacttttggcgcactggtaatcctttgtgtagttctggcgatcgcttcgccgaacttctttaagtattccaacatgatgtctgttctcaagcagacctcgttcaatgcactggtatccaccggtatgctgctctgcctgatcaccgccggcatcgacctgtccgtaggtgcgaacgcaacgttcgctgcctgccttgcaggtatgctggttaacaagggcatgaacaatccggttctgctgctggttgttgccatcgttggcggcaccctgatcggctggatcaacggtatgcttcttacccgtctgcacctgccgcatccgttcgtatctaccctcggtatgaagaacgtactgtggggcggtgcgctgatcatcaccaactctcagatggtatccttctccggtaatgatgctgttatgtggctcggttcttcgaccgtagccggcttcccggtatcctttatcgtagtacttgtcatctacgttatcatgcacatcctgctgaccaagaccgctctgggccgttccatctactgtgtaggcggcaacccggaagcagctcgtctgtccggtatcaactccgctaacgtgctgaccttctgctacaccctgtccggtttcatggcagctctggctggtatcgtatccatcggtcgttccggtatctgcaacggcgttaacgctattcagccgtacgataccgacgcaattgcagcctgcatcatcggcggcgcatccttcatgggcggcaagggcaccatggttggtaccatgctcggcgcgctgatcatcgctgttctgcgtaacggcttctccctgctgtccgtttcttcggcagtacagaacctcgtactcggcctggttatcatcggcgccgtactgctcgacgttactcgtgagcgcatggctgctaaggctcgccgtctggctgctaagtaatcagtccgcgcatatcaaacaaaaaagagtcgctgtaaagcggctctttttttgcgtgaatttggattgatttattcggtacgaagtttgcagagagtgctgcgccctttccgggcggggatagggaacggcagagaattttttctgccgtaggggagcacagtgtgctcccatgtctcgacatattcgcagtatcagaaaaattactgcttcacatacggtttcatttccgctgcgaattttatcttcattggtatcatctttattgtatattcatagggcgaggtgccctcaccccgccgtttatccgatctgcaccatgataatgaacaaatgaaaaatgaaatctcccgctacaacatctcctgcgtgatcaaccgcagatcggtataatacagctcacgcttcggcttcacgccgcgcagcagcatttgatacatcgccagcacggcgtgaaacgactcctgcgagaatgactgaccgatcacgaaatccaccgttccctcgcgcagataccgcttcgcggtgggcgtgaggtcgttgcagacgatatgcggccgggtggtgcgccgcgcttttcgaatgcccgcgatgcagccggagagcggctggcaggccatatagacggcgtgcaggcggctgtcggcctgaagcgcctgcgcgacgagttcgccggtgagttcaggcatttcgttggtttcaatcacgcggtaggcatcttcggagaagcccagctcgagcagacggcggcaaaagccgtccacgcggcctttgtgggcctccatacgcagatttccggtgacaatgagaacgtgctcgggcgggcggatgagccgcgccatgacaccggcggcgatagcgcctgcgcggacaagatcctgtccggcgtggcacagacggccgctgtgcggcacgtcggcatcgtaggtaatgacggtcacgccctgctgcactgcctgctcgatggcggcgcggacctccggcgtattctcggcacggatgatgagtccatccacgccggaacgaatctgctcgtccatcgcgcggagcagctcctgcatggtcatggtacgcagcggctgctcggtcagtacaaacgctggatcggcgatatagcgcagtgccttgcgaatgccgctgacgatctgccggttgaagtgcccatccgtccattgcggaatgagaatagccgcttgcctgtaatctgccgatttcggcggcactggaggctggtagccgagtttttctgcggcacggacaactttttcgcgtatcatcggattgacgttggggcgtccgtgcagcacacggtccaccgtgccgcgcgacacaccggacagctctgcgattttttgtatggtaactgccatgggcacattctccttttctacttcaaagtataggggagagcagcgctgacgtcaagcataactacgcacagtgcacaatcaaaaatgcactgtcatctgcttttgagccttcattttgccataaatttgcggtgcttttttaggcaggctaccaatgttttggtgggacggttgaccgtgacggagagattgcggtacaatgtatgcaatgaagaaaaagtgtgaaaaacgcgggaatccgcgtgtattaacgagattttaagtgattattcctgctgttaaaaaggagaggatcagcatgctgaatattggtgttatcggctgcggcgcaatcggccgcgatcacattcgacgcttgacggaccttgttccgggctgtcaggttgttgcctgtgcagactattttgaagaagctgcgattaaggttgcggcgcagtatgaaggcatgaaggcatacaagaccggcgaggagctgatcgcagcaccggaggtgcaggcggtcgttatcacctcgtccgacccgagccacgcaggctatgtgctcgaggctctcaaagcgggcaagcaggtgttctgcgagaagccgctggcacagagtgccgccgactgcgagaaaatcatcgcggccgagaccgcacacggcaagcgtctggtacaggtcggctttatgcgccactatgaccgcggctacgctgagatgaagcgcatcatcgactccggtgagctgggtgcgccgctgatgattcacgcgtgccaccgtaacgtgtctcagccggacggcttccagaccgagatgggcgtttccaacgttgcaatccacgagctggacatatgccgctggctgctcggtgacgagtataagagcggtcaggtgctcaaggtgcgccagtccgcgtgctctaccaagggttacgacaacccgcagatcgtgctgctggaaacccagtccggtgcgcgtattgacgtagaggttcaggttgcggacgcttacggttacgacatccagtgtcaggtcgtctgcgagaagggcacagtcaacctgcctgatccgtatgcggttgtcaagcgctcgaacgcaacccgttcgttcccgatcctgaccgactggaaggaccgctttattgaagcctatgacattgagctgacccattgggtcaagaccctcgaggagaagggtgagccggatggtccgtccgcatgggacggctacgctgcctgcgtcgcagcagacacgctcaaccgttcccgcggcacgaatcagttcctgccgatcgagatgatggataaacctgctctctacaaataatctctcatataaaagaaaaaggaccgccccagcggtcctttttcttttatattgggttatacggtcagcttttccgcttgatatgcagcacggataaacagggcaagcagcacaaggctggcaatctgcgagagaaaaatcggaatggaagttggcagcatgcgcagcaaaatgttgataagggaaagataaaagcaccagcgaatacgcttgggtggaaaggcgtagccgcgctctgtacagacatcgtccagtccggtgtacagccagaactgcgagacataggctgcgatcacaccggcaagtgcgatcaggctgaacagcagataaaacgtgctgggtgtatacggcggcgtgtcgctcggaacgagcatcatggccagcaggccgacaacggttgccgccacgctgagcacagtggctgtgaacgcacgctgcaggcgctcggatacgcggctgaaccggtaaaacggataaaactgcacgagggtgcagaatataccgagaatgccggtaacggtgagcgctgcaccgtttgtgccgttcaaagtgacggagccgctgaattgtccaagcaccagtgaaacggcgctgcacagccagaacatggaaagccagcgggcaatgggaatgttgttgttcataatctctacctccttgccattataatagcagagaagatgaaaatatgcaagaaaaagcagagcctttcggctctgcttttgtgcgattttacaatatattaatactgtacctgaaccggcttgccggagtggaacgaatccgtaatcgcgtaggtaacgagggtagccttggtgccgtcgtaaacggtcagctcgggcttgcggtccttctggatgcagtcgatgaagtcgaccatttcgagcaggtacgcctctgcgaaacgctgcgggaagttctcgacgatctcctgacgggcaccgtactgatcgtaaaccattacacggtccttccacggtacaccggctacgcggatatgcgcttcggtgccgacaatttcggtctcggtgtggtagccgtgcggcgcagtacggccaacgtgcaggaaagcaaccgtgccattgtcaaacttgagcattgccatgccggtctcggtgtcgccgttctcggcaaactcggggtgcttgaagttggtgcctgcggcgtaaacctcaataacctcaccgccgaggaaccagcgcatcaggtcaatgtcgtgcgaagccgcgtcgatgaagatgccgcccgaggtcttggagaacttgatgcagctctcgaccagtgcttccgggtcaaggccggtagcctttaccagatacggcttgccgatgcggcctgcgttgatctgtgcctttgcatccgcataggacggatcgtagcggcgcataaagccaaggaagaagatcttgtccgggtgacgttcaacagcagcctcagcgcgcttgcactcctcaagcgagcagccgagcggcttgtcggtgaaaacgtgcttgcctgcatcgagcgcgtactcgatcatccagcagtgctccggagaggaggagacgataacgacagcttcgatgtctgcctcgtcaaccattttcttgtagtccgtggtggtgtactctaccttgaggtagtccttcgcccagtccagctccttctgctcgagcgagcaggcagcgaccagcttgcagccgggaatcttgaacgcgagattctgcgcgtgtaccgaaccgagacggcccaaaccgacgatgccaactttgatttccttcatgtttgttctcctttttatagagcggattttctctctacggcaatcgaacgattgccagtctctctctcatattaattttatcactgcgtggacgcgaacgcaaggaaaaacgaccaaatcagagcgttttttatacggtgaaaactggcatttcagcactcggcaggcgggtgtgataaaattccgacgatcatttcataaattgttcacaaacagcacttgactttgcccgtatgtggtggtaaattaagtttagcactcgggaagatggagtgctaacaaccgaaagaaaggagtctgcttcggtggagctttcggaacgtaaaaagcaaatactcaaagccattatcggcgattacatccgcacggctgagccggtcggctccaaggcattgaccgagggacacgagctgccgttctcgtcggccaccatccgcaatgagatgagtgagctggaggacatgggctacctcgaaaagccgcacacttctgcgggacgaatcccctcaccgcaaggctatcgactgtatgtggatgaactgatggagcgtccggccgacaatgcggaggacggaaacgcactgcagaacagcgtgcttaccaaggtacgggagcttgaccacctcattcaggaggccggcaagctgctcaccagtctgacgaattacgcgtcggttgctatcacaccggccatgacacagatcgccatccggcagtttgagatcatcgcagtcgataagatgaatttcgtaatcgtagtagttacggattcgggtacggttaagaacaaaatggtccgcacggtggctgaggtctccaaggatgaggccgagctgctcacctatgtactcaaccagacgctgaccggactgccgctctcgagcatcaccgccgagcgattcgacattgtgcgccgcgccgcgggattgaccgcgctgctcgctccggtggccgagtacatcgcagagctgatcaccgagctgagcgaccagaaggtttacctcgacggtgccagcaagctgcttcgttttccggagtaccgcgatacgaaaaaggcgcagacgctgctcgattacatggaggacgaccgcaagcacctgctgccggccacccgcaagatcgacggcatccagttcttcatcggaccggaaaacggtgaaaatccgctgagtgaaacctcggcgatctacgcaaaatacgatatcggcaagatcggtcagggtgcgatcggcatcgtgggtccgacccgcatggattacgccaagctgtccgcacagctcagccgcttcgcaaaagggctgaacaagctgattgccgagacatttttagatgaaaaagacggaaatcactgatttcctgtaaacggaggcacaaaacgacatgagcaaaaagacaaagccggaggcggaagagcaggagcaggtaaagaccgaggctcccgcagaggagaccgccaaggctgatgcaaagcccgcgacggactgggaagccaagtataacgacctgaacgatcgttatctccgcatggcggcggagtacgacaacttccgcaagcgcagccagcgcgagcgcgagcaggcgtacaccgatgcagtcagccgcgccgtaaccgcactgctgccgacctacgataacctcgagcgggcgctcaaggcagagaccgccgacaccgaatataaaaagggtgtcgagctgaccatgacgcagctgaccgaaagcctcaagggcattaacgtcaccgtcatcgacgctgccgcaggcaccgcattcgatccgaacttccacaacgcggttatgcacgttgaggacgaaagcctcggtgagaatgtcatcgcggaaaccttccagcagggcttccagattggcgataaggttattcgccatgcgatggtgaaagtcgcaaattaagagtggagattggagagtgaggagtggagagattgcttctcttccaactttattctccgaaacacactctatcagatgaagaacgcagagctaagagatacgaaatcttcactctcaactctacactcttcactctatatcaaacagtaaaatgtaaactatatcctaatctttaaggagtgtatttattatgggtaagatcattggtattgaccttggtacgacgaactcttgtgtatctgttatggagggcggcgaagccgtagtcatccctaacgctgagggtgcgcgcaccactccgtctgttgttgcattttccaaggacggcgagcgtatgatcggtcaggtcgctaagcgccaggctgtaaccaacgctgaccgtaccattatttccatcaagcgtcacatgggcaccgactaccgcgtaaacatcgacggcaagccgtactccccgcaggagatttccgctatgatcctgcagaagctgaaggctgacgcagaagcatacctcggccagccggtaaatcaggcggtcatcaccgttccggcttacttctccgactcgcagcgtcaggctaccaaggatgccggcaagatcgcaggtctggaagttctgcgtatcatcaacgagccgaccgctgctgcgctggcttacggcgtagataaggaatccgagcagaagatcatggtttacgacctcggcggcggtacgttcgatgtatccatcctggatatcggcgagggcgttctggaggttctgtccaccgcaggtgatacccacctcggcggcgatgacttcgaccagcgcatcattgactggatggttgacgagttcaagaagtccaacggcattgacctgtcgaacgaccgtatggctatgcagcgcctgaaggaagctgctgagaaggcgaagatcgagctgtccggcatgagccagacctccatcaaccagccgtatatcacggctgacgctaccggcccgaagcacctcgagctgaccctgacccgtgcaaagttcaacgagctgaccgcagacctcgtagagcgtaccatgggcccggttcgtcaggctatgagcgatgctggtctgtccgcttccgatctgtccaaggtcctgctggttggcggttccacccgtattccggctgtacaggaggctgttaagggcatcaccggcaaggaaggcttcaagggcatcaacccggacgagtgcgtagcaatcggcgcatccatccagggcggcgttctcggcggcgaggtcaaggacgtgctgctgctcgacgtaactccgctgtccctcggtattgagaccctcggcggcgtatgcaccaagctgatcgaccgcaacaccaccatcccgaccaagaagagccagatcttctccactgcagctgataaccagccgtccgttgagattcacgttctgcagggcgagcgcgagatggctgcaggcaacaagaccctcggccgcttcaccctcgacggcatcgctccggcaccgcgcggcattcctcagatcgaggttaccttcgatatcgacgcaaacggcatcgtaaacgtatccgctaaggacctcggcaccggcaaggagcagaagatcaccatcactgcatccaccaatctgtctcaggacgagatcgacaaggcaatgcacgaggctgagcagtacgctgagcaggataagaagaacaaggaagcagttgaggttcgcaacaacgctgagcagctggtattccagtccgagaaggcactgaccgatctgggcgacaagctgtccgcagacgagaagagcggcgttcaggctgagatcgaaaaggttaaggaagcactcaagggcaccgataccgatatgatcaaggctgcaaccgagggcctgtccaagaagttctccgatctggccggcaagatctatcagcagcaggcaccgcagggcgacccgaacatgggcggcgctcagggtgcaggcgcacagggcggccagcagggcgactttgtagacgctgacttcaccgaggttaaggacgacgataacaagtaagtaattgaaaatggagaatggataatggagaatgatggttacgcgcttcgcgcgtcattcaattcggcatgaaatgccgttcctcaattctcaattttacattttccattctccattggataaggcgcactttggtgcgcctatccctgtgtataggatgattttttatggctgataaaagagattattatgaagtgctcggcgtacagaagggcgcaagtgatgatgagctgaaaaaggcataccgcaagctggcgcgcaagtaccacccggacctcaacaaggataatccggaggctgcggataagttcaaagaagtaaacgaagcatacgaggtgctgtccgacaaggagaagcgcgccaagtacgaccagttcggctttgccggcgttgacccgagctacggcggcggtgccggtgcaggcggcttcggcggcggctttgacatgggcgatctgggcgacctgttcggttcgttcttcggcggcggctttggcggcggacgttcttcgcgccgcaacgcaccgcagcgcggcgaatccatccgtcagaccgtgatcctgtcgttcgaggaggccgcgttcggctgtgagaaagagatcacgatcgagcgcatcgagtcctgcgacgactgcggcggcacaggcgccgcaaagggcaccacggcggagacctgtccgaactgccgcggcaccggcgttgttacgcagacccagcgcacgccgctcggcatgttccagacgcagggcgcctgcccgaactgccgcggcaccggcaagatcatcaagaagccgtgtccgaagtgcggcggtcagggtcgtgtccgcaagacccgcaagttcaaggtcaacattccggccggtatcgacgatggtcagtccatccagcagcgcggtcagggcaatgccggcgtaaacggcggccccgcaggcgatctgttcgtaacggttgccatccgtccgcacccgatctttactcgcaacggcccggatgtacatgtcgatattccgatttcgttcgcacaggccgcactcggcgatacgctgcaggtgccgaccatcgacggccgcatcgagtacaagattccggaaggcacacagaccggcactacgttccgcatgcgtggcaagggcatccagaacgtcaacggccgcggccgcggcgaccagtacgtccgcgtaaacatcgaggtgccgaagaacctgtccgacaagcagaaaaagctgctgcgtgagtttgaggaaacgtccacggacgagaatcaggtcaagcgcaagagcttttgggataaggtaaaggacgcacttaaggataagtaaaaaaggagctttgctttttgaagaaatacggtgaattggattcggtaagctgaccgggaggtcggctgaacccataaaccacctccccaaaggacgaaaataatcgacttttcaggaggaattcccatgaatcgggagaataaacgcaagcaatatcaaaaggggtattacaaaacgcatgtctgtgacgacagcttcacctgcagggtgtgcggccgtccggtcgtaccggcaggcgcgggcagcgaccacaggaatcactgcccgaactgcctgtccagcctgcatgtggacgatgagccgggcgaccgtgccgccgactgcggcggcatcatggacgccatcggtgtctgggtccgcaaaaacggtgagtgggcagtgattcatcgctgccgacgctgcggtgtactgcattccaaccgcgcagcggctgatgataacccgatgaagctgatgtccatcgccatgaagccggtggcgttcccgccgttcccgctggagcggattgaggagctgaccgcgctcatgggaggagatggctcggtagaataaagaaaaccacccgagaaaatctcgggtggttttcttttgcgggataaaaattgaaaatggagaattgagaatggaaaatgaacgcagagatgaggaattcaccattgttctgaatcgttggcatatgccttatcgtaggggagcacagtgtgctcctatgcagcaccatatcaaacgttttgcgggcgcacactgtgcgcccctacggttacacatctgcaaatgattttggtatgggaacacacgttttaccatcacgataattctccattctccattttccattctcaatcattcacgcgataaatgaaaaacccgctctcggtataaccgggagcgggttttctgcacaattttagatctttagatctgcggcagcaggtttgccagctcgagagccgcgatcgctgcatctgcgcccttgttgccggccttggtgcctgcgcgctcgatggcctgctcgatgttctcagtggtaaccacgccgaacgttaccggtacgccggtctgcaggttgacctgtgcgatgcccttggcagcctcgttgcatacgaggtcatagtggctggtcgagccgcggataaccgcgccgaggcagataactgcatcatacttgccgctctgcgccagcttctgcgccgcaagcggaatctcaaatgcacccggaacccatacgagcgtgatgtcatccgtgtccacaccgtgacgtaccagcgtgtcctccgcgccggagatcagcttggaaacgataaattcgttgaaacgtgcaccaacgattgcaaacttgcccttggttgctactaacttgccttcgagtaccttcatcttaaaatcttcctttcaatatggtgaacagatatattgcagggcgaggtgagatcatcctgccctgcgggatagatggattacaatgtttcactaaagaggtgtcccatcttaatcttcttggttctgaggtagaatgcgtcatccttctgcggtgcaatctcaatcggcacgcgctcggcgatctctacgccgaagccgtccagaccatagatcttctccgggttattggtcagcaggcgcagctccttcgcgccgaggtcctgcaggatctgagcaccgatccagtattcgcgcaggtcgggcgcaaagccgagctttacgtttgcctcaacggtatcgaagcccttttcctgcagctcatacgccttcagcttgttgatcagaccgatgccgcggccttcctggcgcatatagagcagcacgccgcggccttccttgtcgatctgctgcatggctgccgccagctgctgaccgcagtcgcaccggcgggaaccgaacacgtcgccggtcaggcactcggagtgtacgcggcagagcaggttcttgccatcgccgatctcgcccttgacgagcgcaacgtggtgctcgccggtcaggtcgttgacgtagccgtagatgcggaactcaccgaaacgggtcggcattttcgcacaggcttcgcgcacaacgtgcttgtcatgacggcggcagtagtcctgcagatccttgatggtgatgatcttgaggccccattccttggccttctccatcagctcggaggtgcgcatcattgtgccgtcatcgcgcatgatctcacagcacagaccgcactgctcgagtccggccagacggcacagatcgacagttgcttcggtgtggccgttgcgggtcagcacaccgccgcggcgtgcaacaagcgggaaaacgtgtcccggacggcgcagctcctccggcttggtgtggatatccgcacatttgcggcaggtaaagccgcgttcctcggcggaaatgccggtcgtggtgtccacatggtcgatagagaccgtgaacgcggtgtggtggttgtcggtgttgacctttaccatctgctcgagaccgagacggagtgcaacctgctcactcatcggtgtgcagatcaggcccttggcatgggtcgccataaagttgacgttctcggtcgtggcaaactgtgccgcgcagatgaggtcgccctcgttttcgcggtccgggtcatcaatggtgaggatgaggtgtccggcgcgaagctcttcgagcgcctcttcaactgtattgaactgatattccataagagaaaacctccgttaaaatccgtgttgtgcaagaaaatccatcgtaataccgctggatttgtgcggcgtgagcattttttcaacgtatttgccgatcacatcgcattcgaggttgaccggctcgcccggctttttgccgagcaggatggtctgtgcgccggtgtgcggaatgatggagaccgaaaagtcggtgtccgtcacagccgccacggtaaggctgacgccatcaatggcgatcgagcctttttcgacgatgtaccggagcaggggagccggtgttttgatcgtcacccacacggcgttgtcctcgcgccgctgcgagagaaccgagccggtgccgtcgatgtggccggatacgatatgaccgccgaaccgtccgtcggcaggcatcgcgcgctccagattgaccggcgagccgctctgcagactgccgagcgcggagcgccgcaggctctccgccatcacgtcggcgctgaagctgtcgtccgtcagcgcgaccacggtcaggcatacgccgttcgtggcaatgctgtcaccgatttttgtattttcgagcacggtattcgccgcaatcatcagccgagcgccctttgcgccgcgctcgatgcgccgcaccgtaccgatttcttcgataagtccagtaaacattacaatctcccttcaatcaggaagtcttcgtccatcggcgtgcaggtcacgtccttcagcggaagcgcctgcaccatcttgtcaaatcccagacctccgaccggactttttgcgcctgcaccgccgatgattttcggggcgatgtacgcctgcacgcggtgcaccacaccggcctgcagcgcggagaacgcaagtgccgagccgccttcgagaagcagaccgtcgatgccgagtgcgccgagctggcgcatcaggtcggcaaggtctacgcgctcgtttttcgttttgcattcgagaatgtgtacaccgtgccgttccagttcagcggtgcgctcatttcggccgacgaccgcgatataggtcgggattttgttcgccgtctgtacgattctgctgtcgatcggcgttcttgcgcggctgtcgcagattacgcggatcggatcgcgcccgccgtcaatgcggcaggtgagcagcggatcgtcctcaagcacggtgccgatgccgaccatgatggcgggcagccggttgcgcgtttcgtgcacatgacggcgggcggtctcgccggtaacccagcggctgtcgccggtgtgcgcggcgattttgccgtccagcgtcatcgcgtacttgagcgtcacaaacggcgttttgtgcgtgatgtagtgaaagaaaacttcatttacgcggcggcattcatcctcgcacacgccggtctcgacttcgatgcctgcgtcgcgcaggatctgtgcgcctttgccggctaccagcgggttcgggtcgaggcagccgacgaacacgcggccgatcttgtgctcgatgactgcgtctgtgcacggcggcgtgcgtccccagtggcagcacggctcgagcgtgacgtaaaggtctgcgcccgtgcagtcctcggtgcagtgcgcgaacgcattgcgctcggcatgcaggccgccgatgtgctcgtgccagccttcaccgatgatttttccgtccttgacgatgacgcagccgaccatcggattcgggttgacgtgaccggctccgcgctgggccagcgccagcgcccgacgcatatattcctgtttttgctcctgcatagaatcacctgatataattctgtagaaaatttcacgatagtttggcgacagccataaaaaaacgccccaaagacagaatcttcgggacgctgagaaaagcattgtgaaaacaaaaagtctgaaacaccgaatcggcatttcagaacagtaaacaagcggaaggtctttccacatattcttctttcatccagactatactgtcggcttcggaatttcaccgaatcatgcttccgccgaatggcatccgctcgcgggctgtaccgccggtagggaattgcaccctgccctgaagaatcaaatatttggttttgcggggcaaagcctttattgctctgcctgaggaaagtatagtcccaagcggagaaaaatgcaagagttttttgaaaaaataattttacagaatatgagaatgcaaataaaacaccggaaaagttcaaaaaagactggaaaataagcggataacgcacgaaaagtataaaacgactacgcggtctttattgataatttcctgttttctattccgactcgctaagagccgccctatgggcggttgctcgctggacgcccactgcggtgggtgtatccattttcaatttgcttcggttgtgctataatcaaatagctatgaaacgaaaggagagtgtgccatgcggatctggaccggacgagcgggaagcggcaagacaacggccatcctgcgggagatcgcggcgctgagtgaaaagggagagggacggcagattctgctcgtgcccgagctgaactcgcacctgatggagcggcggcttgctgcagccacgcacaaccacggcgcacgcacggccgaggtgctgacgttctcacgattggctgaccgtgtgttctctgaggtcggcggactggcacagcagatgctgacaccggcaggtcagcttttgaccttgcaggaggcggcacgccgtgtgcagggcgggctgagtgcgtggaagggtctggcggacaagccggagctgctgcaggaggcgctgcggctgatcgacgagtgcaaaacctgtgcagtcgcaccggagacgctgtttgcggctgccgaggagagtgaggacgctgtacttgcagaaaaattgtccgaccttgcacagattttgacggcatatgagcgcctgtgcgaggagtccctgcccgacccgagagaccgtctgacacacctgcgcgaccgtctggcagaaagtcacacgctggacggcgcagcggtctatctggatggatttctcggctttactgtgcaggaaagtgcagtagttgatgccatgctggcggcaggtgtgccgctctctgcggcggtaacctgcgatacggattacccggagattttccttaccggctgtaaaacagtgcagaaattaacccggatggcaaagcatcataaccagacggtcgagcgcatcgaactgggcgaaagcaaggtggcccgaccggcgggactggctgcgctcgaacgcgaaagcctgctgccggtgcgcaccccgcaggagagcgcggctggcgttcgtttgtacgaggcggcttcaccgtttgacgagtgtgagcacgcggcggcctacattcggcgcaaggtgcgggacgaaggcgcgcgctgccgcgattttgtggttgcggcacgcgatatcgagccgtacagcgcgttccttgcaatggcgatggcgcggtatgacattccggtgttcctcgcggaaaagccggatctgctgtcccgtccgccgatggcgctggtcacgaatgcattggaagcggtgcgaaattatttccggtatgaagatctgttctcctgtctcaagaccggacttgcgggcttggattgggacgaaattgacaaattagagaactatgtgctcacctggaacatccgcggcggagcctgggaacgcgagtggaccgagcatccggacggctacggtctgtccatcgacgagaacgcgaaggcacagcttgccgagctgaacacactccgcaaacgggcaatcgcgccgttctccgcactgcgcgaggcacttgcaggtgagcagcctgcaggcgactgcgtgcgtgcgctctatgcatttcttctcgcggtggatgcgccgcagcgcatgattgaccgcgccgccggacacgagcaggcgggccgtctgcagctggccgacgagtaccgccagctgtgggaaatcctggtctctgcaatggagcagtttgcatgggtgtgcggtgatatgccgctgacgctcgaccgtttcgcgcagctgttccggctggtgctcggcgagtatgatgtgggtacgattccggtttcgcttgaccgcgtgacctgcggcaacatcgagcgtgcgtgtacggaaaatgcgaaatatgtcatcctgctgggcgtcaacgacggcctgataccgaaaaccccgtcctcgacctcgctgctgagcgacatggaccgcgataaaatggatgcgctcggcgtggaactcaaagcctacggcgaggaacgcctgctgatggagcaggaaacgctctatcgagcactcgcgtgcccgacggacgagctgctgctgacgtatcacaccatcgacgcaggcggcggtgaaacgcggccgtcctacttcgtaaacacagtgcgcgaattgctgccggatgtgccgttttccacccaccggacggagaccgtgcgtgaccgcctgcaggcagaacgaccggcggtcgaactcgcgtgcgcgtatctttcgggcgaccggacagccgccgtgcgggctgcctatgactactataaggatgatgagcgagtcaaaaacgcgcaggcgcagcggcgcggcagaggaccgctgagcagtccgcacacgattgacggattgtacggaaaaagcctcaatctgaccgcttcgcgtgtggatacgttctattcctgccggtttgcattctttatgcagtatggtttgaaggccaagccgcgccgtgtggcgaagtttgatgcgctctcgaccggcacgttcatccactatgtgctcgagcatgcgctggatgctcttggaaagtgcgagggcggcgccgcccatgccgatcagccgaccgtgcgcaaagcctgccgtgaagcggtacggcagtatgtcgcggagaaactgggcggcctggagaacaaaaccgcgcgtttccagtacctgttccgccgactggtgcgcgccgtggagcagatcctcgacaacgtgatcgaagaactgcgcgtatccgactttgcgccgatcgactatgagctggacttctcgcgcagcggcgacctgccgcccgtgcagtgtgaggacggcgatgtgtcggtttcactctccggcaaggtggaccgcgtggacggctacatcaaaaacggtcgcctctatctgcgcgttatggactataaaagcggaaaaaagtcattttcgctgtccgacatctggtatggactcaacatgcagcttatcatctatctgtatgcgctgcagcaggagggtcttgaccgctatcgtgtccgtctgactgccgagctgaacgaaatcgtaccggcgggcgtgctgtacgttccggtgcgcgatgagctgccggacgcggcgcgcgacacggacgaggaagggctgcgcatcctgcgcgataaggcgctgcggcgttcgggtctgctgagcgacgatatgtcgctgctcgaggcgatggagcacggtctggagggtgacggacggtttattccggtctctatcaagaccaggaagggcgaggatgagccgacgcttgccgccaagtctgcggtagccgatctggcgaaattcggcagactggcacgctacacgcagaaaaagctgctcgaaatgggacaggctctgcgaaacggtagcattgaagccgacccgcgcaagaccgaccgcagctactgcgaatggtgtgatttccgggcagcctgccggttcgatgagaccgccggagacaaggtgcgctggctgaaaaacatcaaggacaaggaattctgggagcagttaggaggggacgacaatgccgaagtggacacctgatcagcagaccgcgatcgacgaccgcggcggcgcactgctggtttcagcggcagccggctcgggcaagacagccgtgctgaccgagcgtgtgctccggcggctgacggacgagaacgatccggtcgatatcgaccgcctgctgctggttacctttaccagcgcagcggcagccgaaatgcgtgagcgaattggtgcggccctcggtgcggccgtagccgcaaacccgcgggatacccgtctgcggcggcagctgttcctcgtgcaccgtgcgaaaatcacgactgtgcatgcgctgtgcctgtcgctcgcgcgcgagcaggcggcggtgctcggcatcgcgcccgactttcgcctgatggacgaaaacgagggcaagctgcttcgcgccgaggtgctcgaagaagtgctcgacacggcctacgagcaggcggacgagaagtttttcgcgctctgtgacctgctgacggcggggcgcgacgataaaaagctgggcgaggtcattctcggcacctacgagaagattcaggcgcatcccgatccgcgggcgttccttgaggacgtgcgtgcggggttgtacacgcgcggcatggacacgccgcacggctgtgttctgcgtgagcaggccaggtcggcggcacagcacggtgaggcatttctgcacatggctgtggatgaattgaccggcattgacgagctggcggacaactatctgcccgcgctgacgagcgacttaaatcaggccgagcgtctgctcgatgcgctgtataacggcagctgggacgactgcgtgaaggctgcccggtcgatttcgtttgaccgactcaaggccgcgagaaaatttgaggacaaggcgttcctcgagcagatcaaggccatgcgcgaggagtggaagagcgttgctaataatattcgggagaaatggctgaccgtcaccgcagaagaggcggagtacgaccgcggcctgacagcacccgcgctgttcgcgctcatcgacatggtaaacgccttcgacgatgcctttacggcagcgaaacgtgcaagaaatgctgcggatttcaacgatttggagcactttgccgtgcgtctgctgtacacagacggcaagccgtccgcactggcgaaaaccatgtccgagcagttcaccgaaattgcggtagacgagtatcaggacaccaacgccgtgcaggatgccatcttccgcgcactctccagagacgagaccaacctgttcatggtcggtgacgtcaagcagagcatttacggctttcgactggcggacccgtccattttccttgagaaataccgcagcttcggtgaggcggcggatgccgccgacgggcagccgcgtcgtgttgtcctcgggcagaatttccgttcgcgggcggctgtgctggacgcgtgcaactacctgtttgccgccgtcatgggcgagaccgtgggcgacctcgcgtacacggacaaggaggcgctgcacctcggtgcggactactatccggaggccggaaacgagcggtacaagaccgaagtcctgctcgtggatgcggacggactcggcgaggacgatgatgcgccggacaagaccgaactcgaagcacggcttgccgcgaagcgcattcgtgcgctgctcgatgaaggctttctggtgacggacaagcagaccggaaggctgcgtccggtcacgccgggtgacatcgtaattctgctgcgctcgcccagaagcaaggcaccgacctacattgcggagctggagcgtatcggcgtaacagccagcgccgagcagcgcggcggcctgctggagactgccgaggtcggcacgatggtgtcgctgctcagcgtcattgataatccgaggcaggacgttgaccttatcggtgtgatgcgctcgccgctgttcggcttcaccgagcaggaactggcagatattcgccttgtggatcgcaagatcagctattatgacgcgcttctgcagtcgagaacggctttcccaaaggtggaaacctttctgcagcggctggactttctgcgcacctttgcgtgcgatcagccggtgtaccgcctgctgtgggagatttacgatcagaccggcgcactcggcctgtacggcgcgctgccgaacggcgcacagcgccagagcaacctgctgacgtttttcgagcgggcgcgctcgtttgagggacagggcttccgcggcctgtttgactttgtgcgcctgctgcgcggcatgctcgagcagggcgaggatttccagacggtcggtgccgaggccaccggcggtgcggtccgcattctgtccatccacaagtccaaaggactggaatttccggtcgttatcgtggcagactgcgccaagcagttcaacgacagcgacctcaaggagccggtgctcgtgcaccagaacctcggcttcggcagcaagtgccgcgaccgtgaccgcggtgtgcagtacgacaccgccgagcgcattgcggtctcggtgcagatgcgccgcgagatgatatccgaagagctgcgcgtattatatgtagcgatgacgcgcgcgaaagagaaactgattctgacggcagccaccggcagcctgcggaattctctgaaaaaatggtcgctgctggcatcactcgatgagctgccgcagtacgccatgggcgcggtgcgcacgccgcttgcgtggattctgacaccgctgctgcggcatccgtgcgcgcgtgcgttccgcgaggagtatgcgcccgaggtgcccgagcacggcacggacaatgacgcattcacgctcaaggtgtattatccgagcgacctgcagccgcaggaaactgaaatcctgcgtttcgaggacagggagaccggtgactgcaccgtgcagccgcacttcgactacccgtatgcttacctcgcggatctgccgagcaagctgaccgccaccggtgtcggccgcggctaccgcgcagatgaggccgccgaggagacaccgcctccgcggaaggaggtgcagctgcgcgcgccgctgttcgagcagggagaaaaaaagctgacaccggccgagatcggcacagcacaccacctgttcatgcagttctgcgactttgacgccgcctgtgctccgaacggcgtggaaaacgagctgaaccgtctggcggaaaagaagattttgtccacagaacaggcgcatgctgtggataaacgcaagatcgaacggtttttcgcctccgacctgtacaaaacctttatggcggaaaacaaggtgcggcgtgagttcaagttctctgtgctcgttccggcgcaagcgtattttccagttgcggcggacgcacccgaggaaaatgtgctcctgcagggtgttatcgactgcctgatcgaaaccagggacggttttgttatccttgacttcaagaccgaccgcatcaagaagggcagtgcggtcgagagagccgagcagtaccatccgcagctggccgcctacgcgcgtgccgtgcatgagatttacggcagaccggtccgcgcctgcgtgctgtactttttccacaccggcgataccgaatgggtgtcgcttgacgaggactgacagcatttgaccgcccggcagttaagagcgtgttaagattcatttgcatgcattgacattgcggccgcacgatggtaaattgagtacaacaaaagcgaaggggcaccggaaaaataccggacggctccgcaggacttcaatatgccaccatcattcattcctcatttccaaatgaaaaatccgcagacgggaacgcctgcggatttttctatctctaatctatcgaaaaggaacaggctatattcattaaggttatgcgcgcgatagcgcgcataaaatagaatttactgtgcaaattcgtagcccgtaggcctctatccttaaaaatgtttaatgagagcaaaccgggagcatgtatcggcgcagcgcgtccaagaatccgcgcaaggatagcgcaggttttacaccctgagagggagaaagtttccgtatgggaactttcggacgactttggaacggcccgcggtccgttcctgcttgtcggcgaaactgtagttccgcgacagtttattgcacggattgcataacacgcatgcggcaaaaatcgtgaaaaaccgtcatatgcccgctttactttacagggcaaaaaggatataataaacttaactatcaaaaacgacctatttggagaaaaggagaacgacgaaatggcgtattatttcagtgaaccttcgcatacctttaacgaatatctgctggtaccggggtattcttctgcggagtgcatgccggcgaacgtaagcctgcgcacaccaatcgttaagtacaaaaagggcgaggaatccgcgctgtatgccaacattccgatggtttctgcaatcatgcaggcggtatcggatgatcgtatggcgatcgcactggcgcaggagggcggtatctcctttatcttcggttcgcagtcgatcgagagcgaggctgccatggtttcccgcgtaaagaactacaaggcaggcttcatcgtatccgactccaacgtaaagccggacaccacccttgaggaggttctcaagctgaaggagcgcaccggtcactccaccatggctgttaccgatgacggcaccgctaacggcaagctgctcggcattgtcaccagccgcgactaccgcgtttcccgcatggagcgcagcgttaaggttgaggagttcatgactccgtttgacaagctgatcaccgctccggcagataccagcctcaagatcgcaaacgacatcatctgggacaacaagctgaactctctgccgctggtagacgacaagcagcaccttgtttatatggtattccgtaaggactacgacagccacaaggcaaactctcttgagctgctcgatgagcacaagcgttatgtagtcggcgcaggcatcaacacccgcgactacgcagagcgtgttccggcactggttgaggcgggcgcagacgttctctgcattgactcctccgagggcttctccgagtggcagagccgcacccttgagtgggtacgcacgaagtataaggataccgttaaggtcggcgcgggcaacgttgttgaccgtgagggcttccgtttcctcgctgaggccggcgcggacttcatcaaggtcggcatcggcggcggctccatctgcatcacccgtgagcagaagggcatcggccgcggtcaggctaccgctctgatcgaggtcgcagccgctcgtgacgagtattttgaggagaccggcatctacattccgatctgctcggacggcggtatcgttcacgactaccactgcacgctggcgctggctatgggcgctgacttcctcatgctcggccgctacttctctcgctttgacgagtccccgacgaacaaggtcaacatcaacggcagctacatgaaggaatactggggcgagggctctgctcgtgcccgcaactggcagcgctacgacatgggcggcgacaagaagctgtccttcgaggaaggcgttgactcctacgttccgtacgcaggctcgctgaaggacaacctcggcctgaccctgagcaaggtacgttccaccatgtgcaactgcggctccctgtccattccggagttccagaagaaggcaaagatcacgctggtatccgcaacctcgatcgtcgagggcggcgcacacgatgttgtgctcaaggaaacctcatctacgagcaaataagcatagtttactcacaaattgccccacaggttatctctgcggggcaattcttatcggaaatgagattgcatgaagggggaggggcgctatgcctcagaataacaagccgagacgccgtctgctgcggcagctgtacggctcgtggtaccgcgtgcggcacaatatcagcatttttgcgagatggtgcctgtttgcggtaatcatcggcgtggtcgtcggcgcggtcggcgcggcgtttgagcacgcgcttgaatgggcgaccgaaacccggcaggagcagagctggacactgtattttctgccgctggtcggtgttttcatcgcgttctggtacagtaaaatggatatgccgcttgagcgcggcactaactttatcctgacctcggtgcggcaggatcatccggtgcggctgcgccttgcgccgagcatcttcatcacctcggtgctgacccacctttgcggcggctctgccggacgagaaggtgcggcgttgcagctcggcggtgcgatttcgggcaatatcggacatctgatgcacctggacgacaaggattcccgcacgattaccatgtgcggtatggcggcgtgcttttcggcactgttcggcacaccgcttgcggcgagcgtgttcgcaatggaggttatcagcgtgggcgtgatgtactacgcggcgctgtttccgtccatcctcgcgagcgtgatcgcgcatcaggtggcattgcagcttggcggcggcacgaccgcgtttacgctctccggtgtgccggaaaatacagatgtgctgcttattgtaaagctggtggcgttcggcgtggtctgcgccggactgagtgtgctcgtgtgcatcatcttccataaaatcggccatctgttcaagcattttctgccgaatcagtacgcgtgcattgcggtcggcggtgctgtcgttgtgctcatcagcctgctgctcggcacccgagactacaatggtgcaggcatgcaggtcattgaacgcgcgattgccggtcatgcggcctacgaggcgtttttcctcaagctggtgctgacggcgattaccatcggcgtcggctataaaggcggtgagatcgtgcccgtgctgttcatcggtgcgatctttggcgccgcctacggcggatttttcggtctggcgccgtcctttgcggccggtctcggcatgacggctgtgttctgcggcgtgacaaattcgccgctcacatccattctgctggcgtatgagctgttcggcggtcagagccttgcgctgttcgcgctggtcatcgccatctcgtacatgctctccggctactatggcctgtacagcgagcagaagatcatctattccaagctcagaccgcagtttatcgacagaaaaaccaaataaccaaccatccgtagggcgcgacgactcggcgcgccgtgtaaatcatgtgcagttgctgaaaaggcggcgtgccgaggtcgtcacgccctacgatacacgttctcgaaaggaacaaaaccaatgcagaatttcaaaggtgcaattttcgacatggacggcacgcttttggactccatgccggtctggaaacgactgacacagcgctaccttgcgcagttcgacgttcacatcacagacgcggactacgcggtatgcgagggcttttcccagccgcaggtcgcggagtatttcctgaaacgctatccgaacctgccgctgacccagcagcagatgctcgacggcatggacgagatgatcacctcgcgctacgagacgattgcccggccgaaggacggcgtgatcgactttctcgaaggtctgcgtgcacgcggcatcaaaatggccatcgctacgctgacggcacgccgccacgcggagaaggcgctcatcgaccgcgacatgatgaaatatttcgagttcatgctcaccatcgaggacgtgggcgtgcccaagtacgagccggacatctatcttgaagccgcccgccgtctcggtctgacagcaggcgagtgcatggtatttgaggatgcgccgtatgcgggcgtaacggcgaaaaaagccggttttgcgctctgcggcatggccgaacccgcctacgcggagggcgaagacacgctccggcaggtcagcgatgtgttcgtcgagcattcctttgccgaacttgcggataaattgtaaaaaacacttgcaatataacgcatcatgtcctattatatataggaaagagagtatggagctgcgttagaaatcctaacgcggcttccttttacgttgggaggctgaaatttttggaacaacagaataaaatgggcaccgccaaaatgggtccgctgatcttttcgatggcactgccggcgatgatctccatgatcatcaactcgctgtacaatatcgtagacagtatcttcgtggccaagtattcgcaggatgcgctggcggcggtttcgctcgtatatccgctgcagatgctagtcgtggcgatcggtgtcggcacaggtgtgggcgtaaactcactcattgcgcgccgtctgggcgaaaagcgccagaagcacgcggactcggcggcagagcacggcattgcgctggcagtcgtcggcggtatcgcattcttcatcctcggctggggattttcgggtgtattcgtcggcgcattcggtgcgagcgaggcggtttcgacctttgcggttcagtattcgcaccttgcggtcggcatgagtatttttgttatgatctcgatgatgtgcgagaagatccagcagtccggcggcaacatgatcatcccgatgtgtcagggtctgaccggtgcgatcatcaacatcatccttgacccgctgatgatcttcggtatcggtccgttcccggagatgggtattcgcggcgcggcgctcgcgaccgttatcggccagatcttcggcatggcgcttggtctgtggggcgtgttccgtcaacagaaggtgctgaatgtcaacatgcgcgagttcaagtggcgcggacagacgatcaaggacatttaccgtgtcggtctgccgggtattgtcatgcagagcgtcgtttccgttatgacggcgggcatgaatggcattttgatcgccttctcgcagacggcggtcaacgtactcggtgtgtatttcaagctgcagaccttcgtctttatgccggtattcggcctcaatcagggcgcgctgccggttatgggctacaactacggcgcgcgcaaccgcaagcgcctgatgggtgcttataagatcacgctgacggcggctgtcgtcatcatgggtctgggtctggtgctgttccagctgctgcccgagcagatgctcatgctgtttgtggacaagtccgatgcggcggcagcacaggagatgatcgaggtcggcgttccggcgctcaagaccatcagcctgtcgttcctcggcgcggcgttcggcatcatcaactccacgctgtttcaggccaccgcacgcggcatgaacagcctgatcgtgtctgtctgccgtcagctggtcgtcattcttccggcggcgtggattctgggtcagcagttcggcttgaatgccgtctggtactcgttcccgatcgcggagatcgcggcattctttatctcgtatattctgctctggcgcgaataccgcacggagcttcgattcctcggtattgaaagggaggcaaaggcatgaaacgaattgccagctttgaagtaaaccacgataaactcaagccgggtatgtatacctcgcgtatcgacggtgacatcaccacctatgacatccgcatggtgtacccgaatgcgggtacttacatccagcctgcggcggggcatacgttcgagcacctgtttgcaacgtatgcacgcaactcgaagtttgccgatcagatcatctactgcggcccgatgggttgtcagaccggcttctacttccttgtgcgcgatatgaagccgtcggatgcgattgcgctcgtgcaggagagcatggcgtttatcgccgcttacgaaggcgagattccgggcgcgagccgcattgagtgcggcaattatctgctgcacgatctggcaggcgcaaagcagcttgcagcgtccatgattcccgtgctcgagggctggaaagaagaaaatctgatttatgaaaaataatgcttgcattttcggaaaacatgtggtaagataattttacgactgttggagatatgtaaacatatccgtggaaagaggtgaaacaacatgaaacagggcatccatcccgactacaagcagaccacgatccgctgtgcctgcggcaatgtcattgagaccggctccaccaaggagaacatcgtcgttgacgtttgctccaagtgccaccccttcttcacgggtaagcagaagctggtagacaccggcggacgtgttgatcgcttcaagaagcgtttcaatctggacaagtaatgagaaaagccatcgaaacgtgttttcggtggctttttcgttatctatatgctgcccgctgggggcaagagggtagacacctgcggtttttaccctcttaactcccgtttccctttgtttcttagtttggcgcagaccagagaccggcgaccgctccgaaataggggaacggcagaggattttttctaccgtaggggagcacagtgtgctcccatgtcccggcctatccgcagtgccggataccatactgctgcacagacggtttactctgcgcaggcgcggcatatctgtgccgcgcaactcgtttacgcgttgttatggacagcaactacgagtttaatttgataacagatgttaccgcagggtgcgctggcttacaacgatagggcattttctatataacaaaaatccgccacgaccaaccgtgacggaaaaatattcactttgtttacctttatattaccgcaaatcggacggaaaatcaagtcttgtacggttttgcgtttgggtgtaataaatatagaggacaatttaacagcaaggaggaattttccatgccgtttaccaatcaaacagaagaaaagcagatcgaacgggcggttctggtcggtctgtcgtgtccgagcttcaacaccgatcaggatgcggacgagcgcacgatggacgagctgcgcgcgctggcggagactgccggtgcggaggccgttgcgatgacgctgcagcgccgtccggcgccggatgcccgcacgtttatcggtgagggcaaggcggaagaggttaagcagcttgccgagatgaacgacgcaagtctgatcctgttcgacaacgagctgtcgccgtcgcagatgagcaatctggaggagctgaccggccgcacggtactcgaccgctcggcgctcatcctcgatattttcgcgcagcgtgcgcgcaccggcgagggcaagctgcaggtcgagctggcgcagtaccagtacattctgccgcgtctggcaggtatgggcaaggcgatgagccgactcggcggcggcatcggcacgcgcggacccggtgagagcaagctggagagcgaccgccgtcacatccgcagccgcatcgacaagctgcgccgtgatctggagcaggtgcgtcaggtgcgctccgtgcagcgccgccagcgcaaaaaggccgagttgccgctggttgccattgtcggctacacgaatgcgggcaagtccacgctgctgaacaccctgaccggtgcgggcatcgaggcgaacgaccgtttgttcgatacgctcgacccgaccacgcgtaaaaaacgcatttcggatacgcaggaaatccttctgtccgataccgtaggcttcatccgcaagctgccgcatcatctcgtatcggcgtttaaggcaacgctcgaggagctggcgtatgccgatctgctgctgcatgtcgtggacgtttcggatgaaaactggcagattcatgcacagactgtggataaggttgtggcacagctcggcgcacaggatattccgcgcgtgatggtgtacaacaaggcggataagtgcgatccggatgtcattccgttcattcggccggatgagggcgtgaagatttccgcaaagagcggcgagggcattgacgacctgctgactgccatcgaaaaggcgctcggcaagggcaagcataaggtaaagctgtgcatcccgtacagcgacggcgccgtgcttgatatgctgcaccgtgaagcgcagattgactcgaccgactatgccgcggaaggcacgattgtcgaggcggtcgtggatgataagacctacggcagagtttcaacttatataatggaagattgagaattgagaatggaaaatgtcgctatccttgcgcgagttccgtccgcgctgcgacaagctatccttgcgcgcagcgcgataccataattctcaattaaatttcccatcggagtgaaatagatggaaaaagactactttgtgccttttgccgattacggcgaggataaatttgaagaaaaacgctccaagttcaccggacggctgtggcacgttgaaaccgccgaagaggcggtagcgaagataaaggagatgcgcgagacctactgggacgcgacacacaactgctacgcctacattttccgtgaaggcaatgtgatgcgctactctgatgacggagaaccgcagggcacggcaggcatgccgatcctcgaggtgctgcgccacgagaacctgaccgactgcgtttgcgttgtcacgcgctatttcggcggtattctgctcggcacgggcggattggtccgcgcgtacacgcagggcgcgcaggtggctgtcgcggcggccggggtgcagagaatgagcctgtacacggtggcgctcatcgcgtgcccgtacaatctgtacgagattattctgcacctgctgcctgatcacgactgcgcggtcgaggagaccgactacggcgcggatgtaacgctgaccgtgacgctgcccgccggtcgggaggacgagctcaatcgggcgcttgccgaagccacggcagggcaggtttacgccgaggtcatggagacccgattcatgggtcggcgtgtcaagtagatatcggcttgcaaggctcacaaaattctgaaaaaatttttgtgaaaaaagaggattttcagatttcgtttcgtataactattatgtgacggattctccgaggctgaggaggcggtacatatgaccattcgagagcagaacgaacagcgcgagcatgcggtgcttgagccgtgggcgacctttgcggacagctccgcaggcaggctgcgcccgatggaaccgtgtccgtaccgcacctgctttcagcgcgatcgggaccgcattatccattcaaaggcgttccggcggctgggcaacaagacgcaggtatttatctcgccggagggcgaccactaccgtgctcggctgacgcatacgctcgaggttgcgcagattgcgcggaccatcgcgcgggcgctcggactcaacgaggatttgaccgaagcgatcgcacttggacatgatctcgggcacacgccgttcggccacgccggagaggcggcgcttgacgaggtttgttcgttcgggtttcggcacaacgagcagagtttgcgcgttgtggatgtgctcgaggatttgaaccttacgcgcgaggtgcgcaacggcattgtctgccataccggcaggcgcaaggcgagtacgccggaaggccgcattattcactttgccgaccgcattgcctacatcaaccatgatattgatgacgcggtacgcgcgggcattatccgcgagaacgatattccgcagcatttgagaaaacgcctgggtgagacgcacggcaagcgcattgacacgctggtgacggcgatgatcgagtacggtcagcggtatctggagatcggcatggacgagcagatgcacgcggacatgatggagctgcggcagttcatgttcgatcatgtgtaccacggcacggctgcacagcgcgaggaaaaacgcgcaaaatccatgctgcgcagtttgtacgaatattttatcgagcatcccgacgagctgccggatgattacttcgtgctgcaggcccggggggaggcgctcgagcggatcgcgtgcgactatgttgcaggcatgaccgaccgctactcgatagcggtctataagaatttatttattccgaaaagctggaataagattgaggattaacgaaaatgggtatcatatattcgttttcgttcgataaatagggaaggaggggcacgaaatgccgtttgaccgtatatttctggacgagctgtccgcgcggaacgacattgtagagatcgtttcgcaatatgtgcagctgaaaaagagcggcgcgaactatttcggtctgtgccccttccacaacgagaaaaccggttcgttttcggtttcgccggacaagcagatctttcactgcttcggctgtggcgcaggcggcggtgtcatcacctttattatgaaggcggaaggtctgacctttccggatgcggtacgctatctcgccgagcgggcgggcatgcagatacccgaacagggcgaagccgagcgcaaagcggcgcgccacagagagcgtctgtacgcgctctgcagggatgccggacgctattattatgacacactctggcggccggaaaaccgaaccgcacagcagtattttatcaaccgaggtctgtcccgaaggacgatgaaccgtttcggactcggctatgcaccggattccttccacgcgctcatcgatgcgatgacggccaaaggctacacgcgcgaggaactcatggatgccggtctggtcagccgcagcgaaaagggacatatttacgaccggttccgcaaccgtgtcatgttcccgatcatcgacgtgcgcggtcatgtgatcgcattcggcggccgtgtgctggatgattccaagccgaagtacctgaactcgccggaaacgccgatcttccacaagagccgcaatctgtttgcgctcaacctgtcaaaaagcacgaagaacgattattttatcttagccgagggctatatggatgtcatcgcgctgcatcaggcgggatttgattccgcggttgcatcgcttggcacctcgctgaccgaggagcaggcgcgcattatcgcgcggcataccgaccgcattgtcatctcgtatgacgcagacggagccggtcaggcggcggcacagcgcgcgatcgacatcctgaaaaaatgtgatctgcaggtcaaggtgctgcgtattccgggggccaaggacccggatgaattcatcaaggcacgcggcgcggatgcgttccgcaatctcattgaacgcagtgaggaccacaacgcgttccgcattgagcagatcgccgcaaagtacgatcttgaggacgacgaagcacgcgtgctgttcctcagagatgcagcgcgcatgctcgccggcatcgagagtaccatcgagcgcgaggtctacgccggacgtgccgccaagatggcaggcgtgaccgccgaagccatgaacgttgaggttcggcgcgaactcggcattcagcgcaagcggcgaaaggccgccgaacggcgtgagatacgctctccggtcggactggcgcagccaaaggacaggtcgctggcgtataccgacatgaaatccgcaaaggctgaggagaatgtgcttagacttctgttctcggaccagaaattgattgccgttgccgaaaaggacttgcagccggcgtggttttccgcaccggtgctgcgtaagatatacgagcgcgtgctggaactgaaccgaaatgaccagatggtcgatgtgctgtcctttgagggatggctggagcctaacgaaatgagcctgctgtctgcgatactcgaacccggcattccggccggagagcatcgaggggaactgcaggaatacataaacaccatacgaatgcagcgcgtcaaggatggaaccattacgcaggcgggagaggacccgctgcttacattcggacgcatcaaaaaacaaaacgcgggaggacaaacgatatgacgaaagcaaacgcaaatgcagccgcaaacgcacaggagcagcaggcagcacagcagcagatcctgcgcgacctgctcgcgcttggcaagaaaaacggccgactgaccctcaaggagatctcggatgcactgagccatctggagctgtcgagcgaggacatcgacaaggtgtacgagacgctcgagaccatgggcatcgaggtcgagacgaacggtgtgctggagaaggtcatcggtgacgatgacgactcctttgagccggaggaagtggaagaggttccggaggaagaactggtcgatacctctgccatggctgagacgttcgccattgacgatccggtccgcatgtatctgaaggagatcggcaaggtcgatctgctgtctcctgaggaggaggtaacgctcgcagagcgcatgcagaagggcaacgaggccgcagagcgtatcgcaaacgaaggcgatgccattccggcggaggagcgcgcacagcttgaaaaggatatcaagctcggcgaccgtgcaaagaagcgtctggctgaggcgaacctgcgactggttgtctctatcgcaaagcgctatgtcggccgcggcatgctgttcctcgatctgatccaggagggcaacctcggtctgatcaaggcagttgagaagttcgacagcaccaagggctttaagttctctacctacgcaacgtggtggatccgtcaggcgatcacccgtgcgattgcggatcaggcgcgtacgatccgtattccggtacacatggttgagaccatcaacaaggttatccgcgtttcccgccagctgctgcaggagctgggccacgatcccagcccggaggagatcgccaaggagatgaacatgccggttgaccgtgtgcgcgacatcctgaagatcgcgcaggagccggtatcgctcgagacgccgatcggcgaggaggaggattctcacctcggcgacttcatcccggacgacgacgcaccggaaccggcagaggcggcctcctttatgctgctcaaggagcagcttgttgaggtgcttaagactctgacgccgcgtgaggaaaaggttctgcgcctgcgcttcggtatcgaggacggccatacccgcaccctcgaggaggtcggcaaggaattcaacgtaactcgtgagcgtatccgccagatcgaggcaaaggcgctgcgtaagctgcgtcatccgtcgcgctccaagaagctgaaggatttcctgaactaaagaagcccaaagccgcttaccgacaggtaagcggcttttttatggaaaacggagaattgaggacggagaatgcaaccgttgcgttaattctccattctcagttactgcgatattcgagataccgcaaaaatgcttgaccgccagagatgcgtctatcgtgttgtaaaactgcggtagaatattgcctgagatcagcggaacggccagctgtgcaaaatgccgtcacaggcttccctttgtcagattgtgcgaagggtgttttttcttcctttgtgaagtagcactaaaattatatcattttatttgtaagaaataaacaaaagtgagtgatttcgctgaaaatctttcggaaatgcaaaaaacaaaggaaaattcggattttttatcagaatgtgtgcgaaacgtacactaagtggccgccgctgttattcgacggcgttgtgaaaaatgctacatgaaaattgcacaaaaaactgcttgcatacctggtttgtatggtgtataataacgaagaaggggaacgatcccgcaaagagaggattgctcccgcgaaacaaagcgcccaggagtataacgtgccggcagggcacgatgacaggttagggcaggggagtgtaatataaactatggcgaattatccggttaacaagatccgtaatgtatgtctgatgggtcacggcggcgacggcaagacctcgctggtcgagagcctgctcaatatcgccggtgtaaccgaccgcgttggcaagatcgcggacggcaacacggtttgtgactttgatcccgaagagatcaagcgcaagttttccatttccacggctgtagcgccggtagagtggaacggctgcaagatcaatctgctcgataccccgggtttctttgattttgaaagtgaagtgcagtgcgcactgcgcgttgcggagtccgcgctgatcgtcgcaaccggcaagtccggtccgggcgtcggcaccgaaaaggcttgggctcactgtgaggagcacgcaatgccgcgtatgttctacatctccaagatcgacgaggaaaactcggattactataactctctgcacaagctgcagaagcagttcggcgtatcggtagcgccgatcgttgtcccgatttttgagggcaaccgcgataccgtcggcattgtggactgcgttatccgcaaggcgtaccgcatggaaggcaacaagcgtgtcgagatcccgatcccggacaacatgaaggaccgtatcgaccagcaccgtgcagcactgtgcgagaacatcgccgagctgtctgaggacctgatggagcgttacttcgcaggcgaagagttctcggatgaagagctgatcgccggtatccgtcagggtgtgaaggatctggttctcgcgccggtattctgcggcactgctgcaaccggtatcggctcctacgcactgctcaagggcattgcggactacatgccgtctcccgatgaaaagccggtcgagatctgcgaggacgaaaagggcgagttgattgagatcaactgcaccccgaacggctctacctgtgcatttgtatttaagacggtcgctgaccagtacggccgcttctcctactttaaggttatgtccggcgaggtcaagcaggatatgacgctggtcaacaagcgtgccgatgcaaacgagaagatgggccacatcttcactgtatgcggcaaaaagacgaccgaggttccggtgatcggctgcggcgacatcggcgcggtttccaagctggttaccaccaagaccggcgatacgctttcgatgagcgttcgcaaggttgagcttgagccgatcgagattgcgccgccgtgctacacgcaggcaatcgcgcctaaggtaaagggcgttgaggagaagatctccaccggtcttgctcgtctgcatgatgaggatccgtccttcgataccgagttcaacgcggaaaccaagcagcacctgatctccggtgccggcgatattcatctggacgttctgtgctccaagctgaaggataagtttggcgtagaggttacgctgaccgacccgatcgttccgtaccgcgagaagatccgcaaggctgttacggtagaaggcaagcataagaagcagtccggcggccatggtcagtacggccacgttaagatggaatttgcaccgtatgccgagggcgattacctgttccaggagaagattttcggcggttccgtaccgaagaacttccatccggcagttgacaagggcattcgcgaggcgatggagcatggcgttctggccggctatccgatggttggtctgcgtgcaaccctgctcgacggctcctaccacgatgtagactccaacgagctgtccttcaagatggcggcccgtctggcctacaaggctggtatcccgcaggcaaatccggttctgctcgagcctgtctgctcgctcaaggtcgttatcccggattcctacatgggcgatgttatcggcgatctgaacaagcgccgcggccgcatcatgggcatgaatccgctcgacggcggcaagcaggagatcgtagccgagtgcccgatggcagagcttggcgattacgcgatcaagctgcgctccatgacgcagggcagaggctcgtttgtttcccagttcgagcgctacgatgaggcaccggttccggtacaggaaaaggttatcgcagcgaataaggctcgtctggaggcgctgaacaaggaataacattccctgcattttgtgaaattgaaaccggctgcgtgagcggccggtttttctttgggaaaattgagatgtaatgatacgaaaatggaaaattgaaaatggagaatggaagatgaaatgtaatcgtagggcggggcactccagtataacataatctttacgttcattctcaattctccattttccattctccattatgtcaatcgaaaaattaacttgttgaatcattgggctttttctcctataatgagatttgaaaggggtctgcccatgaagaacaaacgaatgcgctatatatcgataacggcggctatcctgctggtttttgtgctgctgatgctgctgttttccaaccgatcgggagatttcagcgcaatggaagcgcaggacggcgtactggatgcaacatcagcggatttttcgtcggcggtatatgagatagacggtgaatggacgttctatcctgaggtgctcggcagcggcgcagagctggacgctgcccaaccgggagaacgcgacgaatccattccatacggctcatatcggctgaaaatacacgcgcagccgaaacaatacctgacactcggcggctactcattcgattacagcacgcgcgtgctggtaaacggcagtaaagtgctcgaaatcggcaaggtgggggcgtctgcggcggagtctgagccgcgcatcgactacatgctcataccgatttacaccggcgaggatggcgaggtcgaggtggtctgtcagtatgcgaatttcgtgcaccgcgaaggcggcggtctgacgcagatgcacctgtctactgcggagaacatcgaccgcatgcgccgaagccggaatttgtattccctggtgcttggcggttcgctgtgcctgttcggcatgtattttctgctgtttgcggtatttcagggcgagatcaagtatgttttcctcgcggttatctgcgcgctgctcggtctgcgcgaccagaatttctatgtgctgcatctgctgcctgcaaattacaactgggcagttgcatatcggtttctggtgctgatgattacgctgcagccgtgttttctgctgcttttgctgcaaagcctgtacgaaaagctggcgaagccgattgttgtgcggtgctatgcggtgctgtatgccgtgctggcggcggcgcattttatcctgccgacgcaggatattgcaccgctgagcaggatcggatattatctctcgatgccgtttttcctgtatctggtcgtgcagctgattcggcggttctggcgtatccggcggcttgagtgggacgacgtgctcgttctgctcggctatctgctgctgctcggctcgaacgtgtacgaggcggtattcggccgcattgtgacgaccattacgcgccacggagcggcaccgccgtatctgctggtgttcgtattcctgatcgcgggagccatcagtttgaagatcaaccgccgggaacaggagctgtccgagagccgccgtcagcgcgaggtgctgacccagctcaaccggctgaaaagcgaatttctgcaccagatggcgcacgaactgaaaacaccgctcacggttatgagcggctatgcgcaactgaccgactggcagcttagcaccggagcggtcagcgcggacgcgcatgaacacatgcagaccatttcgtccgaggcgcagcggctttctgcgctcgtatcgcggctgatcgatctcgccaacggcggctcacccgatattgagatgggcgtcattgacgcggcgcagctgctgtccggcgcggtggatgtgtgccgtccgatgctggaaaagaagcacaaccggctggaaagcgacagtggagagggcattacgctctggggcaatacggaaatgctgctgcaggtgctcatcaacctgacggtcaatgccaaccgtcacacggagaacggcgtgatcgcctaccgcattgcggacgagggcgagtgggtgtgcctgcgtgtgagcgacaccggcagcggcattgcgcccgacctgctgccgcatatctttgagaagggctgtagcggcgatggaggcagcggtatcggcctgacgatctgcgcggatgcaatgaagattcaccatggcttgctcgaggtggagcacaccgatgcagacggcacggtgttccggctcgaactgccgaaaaagccgctcaaaacacaaggagagaacgattgtggaagataaactgattttgctggtggaggacaacccgcacatcatggcgatcaacgatgcggcactgcacatgcgcggctaccgcaccctgcaggcggaaactgcacacaagtgccgggagctgctgtgctttcacgcggtggacttgatcgtgctggatattcttctgccggacggcgacggcgtggcgctgtgccgcgagatcaagcaggaatacgatgtgccgatcctgttcctgaccgctatgggcgaaaatgaggatatcgtcaagggactgaccgcaggcggagacgattatctcacaaagccgtatgatctggaggtgttcatggcccgcgtggaagcgcgtctgcgtgcggcgcacccgaaggaacgcgcagtacggcttggcccgctgcagatgaatctgctgagcggacgcgcgtacatcggagagaccgacctgaacctgacgcagaaggaatttgcggcgctgctgtatctggcgcggcacccgaaccgcagcgtcagcgcgcaggagctgtacgaggcggtctggcagcagccgatgggagccgacccgcatgccgtgcgcatgacgatctcacggcttaagcagaagctcggcggcgaggatgcaagggtcacggtcaattcgtaccgcagcagcggctatcggctcgaggagcaataattgaatatttacagcggacggcgaaggtaacaaatttggtaccttcgccgtccgccgcttttttgcccttatactgaaagtacggtgaaatacctgtatcctcggacggtgctccgcggtaaagcaaggggaaagccgtggaaaccgtttatttcataaggcaaggaggaagaaagatgaaaaaacgaatttgcagtttgctgctgatatgcagtatgctggcgggtctgctgccgcagatcgtgctgccgcaggcggcggcagcggatactgcagcagcaagagacggctttggtttgcccacggaagaaaaaacgggcataacagacacagccacacttcggaataacccatacggcacgctgggatgggttccgctgttccagaaccacgagctggttgtagccggtgtggactcggatgaattccagacgacatacgagggcgcagccaacggcaaggacaagggcagtcagatgtctacgttccggtggagcaactcgaccgatgtcggcaatgccgagcgtattgcgactgtggcgtttgatccgaacggcaccggcaaggatgaatacattgcgaatctggtatttgataaaagttcggaacggcttcgtctgtatgtgacgaacaaggaccgcaaggtatcgaacgttgttcagatcggtgacgatgatgacagcaggtacatcaagaaactgaaattctaccagacccgcgctatgctgagtctggccgcaggcgactttgacggtgacggcaaggacacgctgatgatctatacgccgggcaataacaaggatacggctactgtagacagcattaaggagtatacgttcagcggcagcaaactgactgacaacggtcgcgtaatcaacctcggtgacgtcattgacggcggccgagaggcgctgaaggccatgctgtaccacgacggcaacggcgataacgagctgcgcgcgcatctgagcgttgatatggaagtcggcgacgtggatatggacggtatcgacgaactggcaatgacggtcaatgtcaacgacctgaaagagagcgaatacaagctggatggtaaaacatataccgactttgaaaagtcttatctgacggtttacgactacaattacgactacaagaacgacaagggcagctggactcagaagctgaacaagaagctgctgaacagcaatgacggtccaagcggccgtgctcgctttgcgggtgtaaccatcggttatgtcagtaatgcgccgagcggcagcatgccgccggaagtcgttgcggttggctactacgataagaaggataattatcgggactgcgagtttgacacgagcaagctgctggcatacagctatcagtacagcacgaaggataattcgtggacagagaaatgcaaggcgaccgaagttgtcaccaacggctttaccaataccggcaccaagggtgacgatgtgcagaatccgatcgcggtagcggctgttgcagcggacggcgtgaactcccaggaatatctgttcatttccggcagtatgtataaagtcggcacggtgaacggcagtcagcagctgtctatcctggacggctcgaataagggccatgaccgctggctgggcggccgactcatcaacaacagcggtattctggactatgctgtcggcaattttgacggcaacaagcagggcatggaacaggtatactacgttgagtaccgcaagcaggagaccttcgacaagcagtttttgaagattggtcagctttacaaaggctcggctggcagcacgttcagccgctgggaggatgactggacatactatgacaagagcaactgcaatctggcgattgcaacggcagatgtaaacaacgatgccatgctcgcgaagatcaaaagcgtcagcaccggctataccgacccgaaggtaatggcgattctggaggcgtcgccgcatttcgcggaggtaaatgacggcgatatcggaaactcgcagaccggaatcggatacagtaaggataatactgtagcagtaacggcatccggttcgattggttttgatatcatggcgggctttgaatatgttgcaccgctgattgagaccggcggcggtgttgaatttaataccagtcatacctttactgttggtgcaacaaaatctacaagcaaggaaataaaggtcgagtattctaatgatacgaacgacaatatggtgctcatgtatgcaaccccgatgacatattacgagtatcaggtgaagtatccggatggcacaaagaagggcaattcgccgaagctgaccagttctatgacgctggcggttccgggtaatccttcgatgaacatggtttcggtagatacttataataaggctgcttcggcgtacgagggtatgcagcagattggcagcaacctgcatctgggcacgtccggtcagccgaatacgtatcgttccagtctgccgagcggttcccattcggagcaatccggtaaagttggtcattacaaagattcgggtacacagctgcagagttttacgactgcaaccagcagcggcgtaaactttgagtactcctatgagggttcggtgcagatgtatggtgtagttggcggcttcaaggctggcggcggctatcactggggagcaagcgccggaaccgaaaaggtaaacaccaatacgattaccaagctgggctctgttaccggcggtggtgattcgcgctataactttgactggagcttcggcacatggacggtaccgttcaacggcgatgaagtaccggtattgggctatgttgtcagcaatgtgacggcaccgccgtctccggcgcaggatctgtcgctgagtgagcagaccaccaacagcatggtgctgtcgtgggaatccggcgaccgtccggcagagtattacaagatttaccgctatcttgaagataataaggaagaaccgttcgtattgattgatactgtggatgcggctgaatcttcgagtggtgagtatggatacacgctgaaggatcttgcacctaatacgaagtatcggtatgcgattacctcgggatattacaccagtcaggaagaatcggttgaaagcgagattattgccggtacaactctggcaaatgataagagccgtccggacatcaacggaccggataacgtaaccgttcagatgaacggctcggcgaccttcaatgtactggcttctgtacctgctgagtacagcagcacgagataccagtggcagcagcgtctgccgggcaaaaagtggggcaatattgcaggggcagctaaggacagctataccgtaaagtcggtaacgagtgacctgaacggtgcgatgtaccgctgcgtggtaacatgttatgacggtgcaagaacgccgatttcgttctacagtgatgcggcaacgctgacggtcggtacaccgcaggcaaccgccggtttgacggtatccggtactttggagggcagcggcgctcaggataccccgtatatcggtcagagtaatttcaacacggttaaaaccacgacagaatccgtagagacaaccgttccgtgcaccgtagaagtcgatggcatgacgctgaatgtttacgcagtaagcaatcaagcgggtgcggtacagggatatgtcggcatcgatgaaaagaaggaaacaaacggttcgatatcgaccgtatactacgccgtaacaaagactggcgagaagtataccgcaggttcggaactcaccatggagaccacctatcagtggaagaacagtggtgcagacgcagcagtgccgggcacaattacgccggaaaccgtagtgatagacaaaaacgaaaacgaaaatgaaaacgcaaaagcaaaagcgtttacgctggacagtgcaacgaatgcaccgacagacgcggaatacgacgaaagcaagtaccggaacggcgagcagtacctgattcacggtaaggatactgtgacggagaacgaaactacgtttgaccgctatattctcagtacaatggctaagtcgaccagtggtagcgccggtgcggaagaggacacctatactgtcaagtattatcagctggtgaagaaggcagagaacagctatgaccggaccgagctgacctgcacacagcagacgaagctgggcagttatacggatccttcgttcacactggtaacaaaggaaactacggttgaaaataaggttactacctctacgccgggttctggtacggcgctgaccctgacgacgaaaacggcggaaaagaacggcgctgcactcggcaatgtggagtacacgctgacgattacgaacacgtcggacggcacggtcagcacgattgtcggcagaacagacagcagcggcacggacagcaaaacgtggaccgcaccgacagccggtctgtatgccatcacgaccaccgcgaccggcggcttgacaagtgatacggtatattatctggcaggcgtgcagagtgtagagaacggcgagaccagcacaacggagaccgtttacactcttgaaagcactgttggcaaagaaaacaagattacgagcgtatacggtacgccgattgatctgagcgtgcagcagcagactgtaacgaaaaacggaaacgctgttaccgcaggcaacaaaacagaggttacgggagatatcgcctacacctggcgtcagtccggtcagagcgagagtccggaaacggctatcactgacagcattttccgaccggagaaggcgggaacctatatcatcacggcatatcaggattacagtgatacctccaagcgcaccaagctggcgtccacgaccattacggtaaagcgcaagccgctggagctgcatgttacctggccgggagataataaagatcataattcgaccgaggcaccggacaacagcacatttgaggtttggtcggatgatttggagtcgggcgacaccctgccgtcggcaattacagccgcatgtgcgctgtatgataacgatggcaaacgaaagaacgtcagcggccgctttgaggtaacgattgcggtcaacggtgaggacgcggctgtgaagtcgctgctcgagaagtacgagctgaatctgaccaagcgcatgctggttgtcaagcaggacaccctgagcgtaacctatcgcgccggtgaaggcggctcgcttagtgcaagctacaacagcggcaacctcgaccagaagtttgaaagcggtaagaatatcgctaagaacaccaggctgatgtttgatgccaagagcaacgacggtttccttgtaaaggaatggaaggtcaacggtcagtccattaccgatactgcaaagtacaaggtgacggagattctgtcgaacggcaaaaaggtcggcgaacgactgacggtagcggcgctgacggaaaagctggacgtagaagtatccttcagcagtgattcgcacacgattaccttcagcagcggcgaaggcggtaagctgaccgcagcactgaaggacggcggtgcagtcacgaccggacagaagattgcggaaggcgcaaatgtgacgttcacggctgcgccgagcagcggtatgtcggtagcacgctgggtggtggacgaaaagccgtattactggccgggtacgaccgatttgtaccgtgagtccacactgacactggaaaatgtgcagaaggaccgcaaggtagcggtagagttcagcaaggcaggcacctataagctcaccttcaacatcgagtcggaaaccggcagcactttgccgtccgtgcagacctcggcgaagctggcagacggtactgcggcagatctgaatgcggtgccggacggtgcggcagtaacgtttgcactggaaaatctgggcagcaactacacggtcaagacgtggaaggtggatggtaaggaagccgcaaattcgggtacgcagaagcagtttacgctgcgcaatatcactggaatgcatacggttacggctgtgatcaatgcggcgcaggaggtaacgctgaccttcaaggcagtggatgcaaagggtgacccgataaacgcagacgcaggcatcgcttccgttaccgcaaagattaaaaacggcaatgcgattaccaacggcagtaaggtcggcaattattcgacgattgagtttgctgctgcggtaaacgagaattactacgtttctgaatggaccggtgcgaaagcggatgcggaggattcgacaaaggcatccatcgcaagtctggaaaagaccactgaagttatcgcgcatatcgcggagaagccgcaggtgacggtggctgcgccggtcaacggcacagtcaaagttgctggcacacgcggcatccagaatgttgtattgactggtgctgagggtgaaaacggtcatgtgaatatgaacagcacggcagcaatcacggcaacaccaaacgacggttatttcgtgcagaaaatcatggttacggctgatggtgcaacgcagacattcgattacgacaatgcgcaggcttatcagtcgggcaaggtagcgaaggatgatatccagattacgaaggataccttggttcaggtaatctttgccgagaagccgacggtaacctttggcggtgacactcacatccatgtaacggcacagcaagacagcaagatgctgaacaccggcgatcatgtcgagaagtacagcggcgatatcgtattcgcggcaacaccggatgagggctatgagactgataactggaccgttaccggttggacgaatgtcgacggaaacgacgataccacttatactcagattggctctatcgaaagcaatgtagaagttcatgcaacgtctaaggcgcttccgcagtacgacttcatcctgtccgttgattcgctcggtgacgagggatacggtggcacggtttccgcagaaatcacccgcaagggcatgagcgcatacgaacaggagaacctcgaagcaggcacgcatatcttctaccgcgactcggatatcacgatcacggcggtgccgaacgcaggctaccgcgtacaggactggaccatcaacggccagaccacagcggataccgcagtgagcaagacgctgagcaatctgcagggtgaaacgacggttcaggttcgctttgtcaagctggtgaccggcattaccttcggtccgacggacgaaacaagcgaaggcggctatatcagtgcggcagaggcgaatgaaacgtctatcctcggtgatgcggctaccggcgcgaatattgcggcaggcgtgccgatcaagttcacggcagaggtaaagcctggttacgcaatcgaaggctggtacgtcaacaatgtgcgtgatgacagcgcaggcacaggcgaaacctatacctatccgaacacgaccagtgcaaactcgatttacattgcaccgaagttccagcaggtcgagtatgacatcaccaccggtgataacgtcaccgtaaacggacagaatagcacaaccgcacgcggcggcgaatcgctcacctttacggcagtaccgccggcgggtcagaatgtgaccggctggacggtcaacggcgaggcagttgccggtaacggcaatacgctgacgtggacggtcgagaacggctgtctcacgaagccgaacgtaacggcatatcatgttgaagcacagttcagcgcaggagagtacaaagtaacgtacagccagccggcaaacggcacgctgagtgcatcggttgcagctggcacaccggtcaacggcggtactaaggttgccttcaccgcagaacccgataagggttatgagattgacgagtggacggtaaacggtcagaccgttgccaacagcggcagcacttacaccctgaacgtaaccgaaaacagcacggttgcagtcaccttcaaggcaatggttccggtcagcgcagtgccgaacggcagaaacggcaatatcgccatcaccgcaaacggcaagacgatcacggacggctatgtttcctccggttcggacgtaaccttcaccgtaacgccggaggatacggacgatatggtgcagacatggcaggtgaacggcttgacagtcgctgagatgaccgatacggcagatgtaccgctcacttatacggtcaagaatgtaaccgcaaagactgaggtttctgcaacgctgattgagcgcccgacatacaccattacggtaacaagcgagggcagcggtacggcgtcggcagaaccggcaagcgtcaagcgcggcggcggcacgactattacggcagtgccgagcagcaatagctactacctcaaggaatggtcggttaacggcggtgctgcacaggctgcctccggcaatacgctggcactgacggaaattcgcagaaataccacagtcaaggccgtatttgacggcgcaatcaactacgatgtaaccctggatgttcagggtgcagataccggcacaacggttgctgcagcggcaaacggcaaggccattacgccgcagaagaacagtccggcaagtgttacccgcggcagcaaggtcgtattcacggcaacgcctgccgtagaaaacggacgaaacaagcagatggtcgcacagtggatggtaaacggtgtagatcagaataacatctctaacgagctggtgatcccgagcctgaccggcaagaccgatgtagccgttaagtttgtggactacgcaggcttcgctatcccgaccggcgacaccggctggaaggtctccgatgtgaagcgcgtgccgaatgatacgcagccgacgagagaaatccgcaagaacggcgatctgacattcacagtcggtctggcaggcgactacacggtaatcagcaagctggtcatcaacggctacgactgcatcaacggcaaacctgccggaaatgcagcgctgcacggctgtgacgcagtggaagccaagaagaacgcaaacggcagttacaccgtcacgatcaagaacgtaacggcagagccggatatgagcgtagaagcgcatcaggtaatcatcggcagtctgaccgttccggagaaattcaaaaatattccggaactggatacagtcgaaaagattcaggcaaagctgacagcggaactgaccggcaggaaggacggcgtggcgttctacgacatcgcgcttaaataccatgacggcagcaagtggattccggtagacgaaaacaacttcccggcggaaggcgtagacgttgttctgccgtatccgaacggtacggacagcaaggataccttccaaatcgtccacatgctgaccaagaccggctccgagggcaagatcgagaagtttacccatatcaccaaggagaccgatggcctgcggttccatgtaaccagcctgtctccgttcggcgtaagctggacgaagtataccgcgccgacgccgaccggcggcggtggcggcggcggagccgttgccccgaccacttacgacatcgtgatcccgtccgcactggcgaataccgtcaaggcggataagaccaaggcggctgcaggcgacaccgtaacgcttaccgtgtccggcgaaggcacgctgaccgttacggacgcaaatggcaagacggttgccctgaccgacctcggcagcggcaaatacacctttaagatgccgtcggctaaggtcagcgtgggcttcaagaccaccgcagaccagccgtgcgatggcggcaaggattgtccgtccgcaccgtttacggatgtagatactgcaaagtggtatcatctgtccgttgattatgtgctcacgcacaaaatgatgaacggtgtatcgagccgtgcatttgcaccgaatgccaacctgacgcgcggtatgctcgtgcagatcctgtataacctggaaggcaagccgaagggcacagcagcgaacttctcggatgtgcaggctgacgcatggtatgccgaagcagtcggctgggcagcgtccaataaggtcgtaaccggctatgcagacggtaccttccgaccgaatgcagccgtcacccgcgagcaggcggcagctatcctgtatcgctacgcccagagcaagggtatcgacgtaagcgtgggtgagaataccaatattctcagctatgtggatgttcagcaggcaagtgagtacgcgattccggctctgcagtgggcagtcggcgcaggcgtgctgaacggtaagaatggcggccgtctggcaccgaccggcaccgccacccgtgccgagatcgcagcaatcatgcagcgttggtgcgaaaacatcatcaagtaacggcagacaaaacagcaggacagagaaaagggctgacccgacgggtcagccctttttttatgcggttgaataatggagaatggaaaatggagaatggaaaattgacgtgacgattttctgttgcgtgggcggccaatgaccgcccctacggttacgcgtgtgcaggttgtttgatacggtgcgccgagtcgtcgcaccctacggtatagtcttacatcagatacaattcgtagatgccgtccgtaacaacgcgcaaacgagttgcgcaacactgttatgttgcgcctgcgaagagtagctggtatgtgtagaagcaatgtatctggcactgcgcagaggtagagaaatgggagcacactgtgctcccctacggaagaaaaaatcctctgccgttctccttttcgaagcggtcgccgctctccgattttcgccagactatcccaaagggaaaggggtgattcacaagagggtggaaaccttggtgtctaccctattgtgcccctgccgggcaggcaagattcattcgcttcgcaagcgattactctacaagcatcgctgcgcccaccagacctgcgtcgttgccgagcgacgcacagacgatctcggtatttcggtcctcaccgcggaaggtctgcgggaaagtgagcatgcgcagcggctcgagcagcttttcgccgtagcccgccagtccgccgccgagcacgatactctccggctggaacagattcacaaaacttgccagaccgttcgccagattgccgcagtattcgtcgaacagctcctgcgcgagcgcgtcacccgcgtctaccgcatcgcagatctgcttggcgttcagctgacccttgtgtacagcaagcacgctctttcgtccgtcctcgagcgcacgctcggcaaaccgcacgagcgaagccgccgagcagtacgcctccagacagccgcgccgtccgcagttgcacggctcgccgtcttttcggataaccatgtgcccgatctcaccggcaatgccgttgcagccggtgtacagctggccgttaatgataatgccgccgccaacgccggtgccgagcgttaccatcagcatgttgcgcgtgcccttggccgcaccggcagtcgcttcgccgagcgcggcgcagttcgcgtcgttatccagatgcaccggacagccgaactcaggcaaaaacgcatccgcaaagctgacgttattcagacccagattggtaccgaaccgcagggtgcaggttttcttgtcaaacgagccgggcacgccgatgccgatcgccgttacgtcctctaccgcacagctgtgcgcccggcacagcgagagcgccagcgttttcatatctgctttcaggccagctgcgttgccggtccgggtcggaaggctgtccttgcacagcagcgtgccgtcctcggtgcagagcgccgccttgatggtcgtgccgcccagatcaataccgattctcacagcaaatcctcctcgtcgaacagatgcaggccgcggcccttgaaatagttgttcagccgctccacactgctgttgatgatcagctcctccgggaaaccaatttcctcgagcatttccagtgcgccctccacatgaccgacgcggtagcagatatggctgtcgctgtctaccgagataggcacctcatacttcatgcacaggcgggcgatgtccatgcagttgtcatggctgcccttacggatggacagagatgcgttgttgatctcgacaatcttgccgtggtcgttgcagcggctgatgatgtactcgtggtcgaacgggaagttggagttgccgaggtggccgaacgcgttgacatacgggttgtacaggatagcctcgagcgccgccgtgtgcacgctgctgtccaccggcgggaacatgcactcgtggaaggatgcgagcgcaaactcaacgggcttgagactcttgttggaaatgacgttgatgccgcctgccggagcggtgatgtcgaattcaatgccgcgaatgaccgttaccttgccgatcttgcgcgggataaggtccaggttggaaaaatgccactcgtgcgggccgtccggattggtggggccgtggttggtgatggcgatagccgcaagaccgcggtcctcggccgcctgcaccatttcggtgagcgtgctgaacgcgtggtcggttacattggtgtgggtatgcaggtctgcgatgatttgcatgggaaaaggctccttttgacgtatgagttttgggggtaagatgaaaggcggacacatgggtccgcctctgtatttgcagttcgctgaaccgccggtatgcgattgtttatcggcggtgtctgcgcggataatcatcgttatcgtagcgcttgcgcatcgccttgcggcgacggcggcgccggattccgccgaatgtgatgttgaacagaatgtacagcacgatgaagattgcggctgcaatcagcacgattttgaacacggtgctctggaagaaatggctcagcttgtccgagtaatagagtacgcggctcatttccacatcgctgagcgcgaccagttcgaccgtgccgtaggacgtgccgttgtagctgtatgtcatgctgccgaccacatcaccggccttgatgggcgcgtcaacggcttccggcagattgggtgtcgcttccagcgaatcggtctctacatcggcagggagcagcgccaccagatcggttttcgcggtcagcaccagctgatcggtctgcgtggacaggtccacctttacatgggcgagcgtgtcgccctttttcgcaacggtcttggtcttaaagtgggtgaagccccacttatacagcgatttggtatccgtgaagctggccgctaccgtcgggtactccttggacgaggcggcactgccgagcacgaccgaatacagcttggcatcgccgtactccgcgtagccgacaaagcagttgcccgcctgcgaggtatgtccggttttgatgcccttgttgtacgggtacgaccacggattgaacgagctgaagatgagctggttggtggtgaagatgatgcgttcctcgtgcatgttggtcttgggcatacggtactgcacggtgtcgataatgttggtgaacgtgtcgttcttcatggcctcgcgggcaatgaggtacagatcacgggcggtggtgtagtggtcttcttcgtgcaggccgcatgggttgcagaaatgcgttccggtgcagccaagctcctcggcgcgggtgttcatcatgtccacaaagtgctcgctcgtgccgccgacatggcgcgcgagtatgtacgccgcctcgtttgcggagggcagcataagcgcatacagcaggtcgatgacgcgcacggtctcaccgaccttgatgtctgcgttcgagctgtctgctgtgaccttggcgaagtcgccctgctcggctgtgacggtctcgttcagatccttgacattctcaagcgtcagcagcgcggtcataattttggtcgtggacgccggataccgcttttcgtccgcatttttctcatacagcaccatgtcggaatccgggctgatgagcagggcggcggtagccgttacggcaggcgcttcacttgccgctgcggtaacgtccttgtcgttgtcggcggtcgcgtccttggaatccttgctgtcggcagaatccgtactgcccgaatcggtggacgatgtatccgcgctgtccgaatcggtggacgaggtgtccgtgctgtcggaatccgactggctcgatgaggtatcactctcgtcattcacggcataagcgcgggtgatcggcgccgcaccgagcagcagcgtaaagcacagcgccagtgcggtaagacggtttttgaaattattgctcttcatcggtatctcctaaagaaaaatcggcatcggtgaagtgcccgcgcagaaccgccggcttgggcggtgtgcgccgcagcggatcgtagcggaaggaacggcagtgatcggtgccgtttaccacaccgcgtttgcggcaggcaatgcgttcgccgtccgccagcggagagccgtgcgcgcagtaggtgcagcgcggttctatattttttcgcagcagctttttgagcctcatgcgtggtcactccagtcgtgataaaatcaggtgaaaagtgtccgacaggatcagtatcggcggacacaagacatatataaatattatatatcatttcctgcgttttttccaccccaaaattggatacaaagcggaaacgaacagcacagcaagcgtataccggaaccgtaccgatatcggtgtcagctccggtgaggaaaccgtcagcacggcaggcgagagggcaaacaggaaagccgtcagcacagctgcgagcgtaccgtgcagcagctttgcggcaaacaggccgcgcaccggcaaatcgtgtgcttccgcgagcgcgcgcacctgaaactgcacagccagtccgccaaatcccagcaggaaggacgcaagcgtcagtcgcgtcctgcgcggcagcgtcagcaccgtcagctcgtctaagccgttagtcagctcgatcatgccgtccagtacgtttccgtacggcaaaagtgcaaaaaccggcgaaagcagccgcagcaggatggaaaacatggtcagaaatgccgtcacggtcagcgctgtggacgctgcctgctgtacggacgcgcagaaaatcgaggggaatgaggtgcggttccggttatggatacgctgcgacacggcggataatggggtgcgcgcgaaaaacaatccgacgatcagtgccgaaacgatatgtatcccgtacagcatcgcgcctgcctgcgcggagccgaatacgccgagaccaaccagtccgatgcagaagcccggactggcgcagttgcagaaccggttcacgcgctctgccgcttcgcgggaaagcacaccctcggagagcagcgcacatgcggtcgcggcgccgaccggatacccgccgatgagtccgagcaccagtgcaggcgcagcctcgggcggcaggccgtataagcgggcaagcggctttgccagcagcggtgacagccgcgcggtatcacagcggacaagcagtccgctgacaacgaaaaacggaaataaagccggtaaagcctgcactgcggctaaagaaagcccttcgcggacaccatccgcgcaggcagtcgggcaaagtaaaaacgcggcaaaaagagccagcgataagaacagcttcatagcgtcacctcggaacagtgtatgagaagcaggaaagtttcagtacgtttatacataacatataccgttatacctgatataccgtagggcggggcactctggagtgccccgccctgcggagaaggtaaaatgcgatatgaaggtggcgcaacatgctaaaagataacttatacgccgaactcatggaggacctccacccaaaccgcccgcgtgtggaaatcctcggagacagccgggtgatcgtggagaaccactgcggcatacaggaatacgacgacagcatcctgcgcgtcaagtgccgcgggtgcgaggtgcgcattctgggtgcggatttggagctgacggcgctttccatggacgaactggcggtgatgggcgtgatttcgtcggtggagtacatcacgaccgagtgagaaaggaggggcgcgaatgatcgggcggctgtggctgctggcctgcgggcaggtgcgcgtgcgcgtgacaggcgcaagcctaacgcggtttctcaacctgtgcgcggcgcaaggtatcacgctgcggcagatggaccgcacggcatggaatgagctgcacgcaaccctgtccatccgggatttccggacgctcaggcggcacatgggccgcacgggatgccgcgtgcatattctccgaaaacgcggtctgccgttccttgcggcgcgtctgcgtccgcgcacggcgctctggggcggagctatagcggcagcggcgctgtgctggctgctcggcacgcatgtatgggcgatacagaccgagatcgcaccggcgatagacgaaacggctgtcatgcagcagctgagcgaaatgggcgtgcgcatcggcatgcccatcaagaagctgaacacccgtcagatacggtggaaaatgatgcagctgcagccgaatatcacgttcttttcacttaatctgcggggcaacagcctgaccgtagtcgcctacggcagtaccgacccgccggaggtgctggacgagcacgccattaccaaggtggtggccgcgcgggacggcgtggtaacgcaggtgcgtgcgctcgagggacagccaatggtgcgggcaggagacgcggtgcagaccggcgatacgctcatcagcggtcttgtcgagccaacacgcgaaggcggaaagtaccgcacagcgcatgcgcacggcaccgtgcaggcgtacaccacgcatacggttcaggcggcgcggccgctcaccgagcagagcaagcggtatacgggtaaaattcgtcatcaatatgcactggtgatgggaaataaacggttaaatttctatattggcagtggaattgcagggggtacttgtgataaaatagtaacgaccagacatttttggctgtcggacagcgtggtgctgcctgtggcgctggtcacacaaacgtatacattctacgagcgggagccgacgacgcgcaccgtcgaggacgtgcgggtggatatgctctcgcgcgcactgggcgagaccgccgcagatatcgacggcatggtgacgagccacagcgaaacgctcaccgagcagaacggcgcggctgtgctgcacctcactgtccacgccgaggagcaaatcggcaccgaggccgtggatgacagtaccattccggaggaaaagacggagatggaacaggtgccgtagagacagaaaaggagacgcctatgaaccgtaaactcatgacgattctcgcaggactgagcactgcagcggcgtttgccgtaaacggctcggactggcttcacggcggttccgcgagcgcaggcaaattctgcgtcagcgcggtgtttatcgtgctgatatcgctgctgctgtacgaatggcggaaaagcaatactgcaatgtgcctgctgacgattgcatcggcgctgattgcgattggtgcggcatccggtttgcttatgacgacggatatccttccggtaaattcggtgctgctgccgtttagtgtgtttctcgtgccgtttttcggcgtgacgaattttatgacatccacagctgccgcaatgtttctgccgacggcggtttcggtggtgtggctgtgttttgcggtgggattctggtgcgtaatcggaaaaaataaacgataatccgcatgttataatcgctgcacaaatttacaatataccgtagggcggggcacccagagtggcttctcttgcggctttgccgcaattcaccttctgccatcaccccgccgtgtaaacaatcggtacatgggtaaccgtaggggcgaccggtggtcgcccgtgcatccgtttcgccatagcgtgggaggccaatggcctcccctacgggataaatattgcagatgaatctacattcggcggggtgagggcaccccgccctacgaaaatgatataactactatttaagagggtgtaaccatagaacaggtaatgcaaatcgagcagactgaactgctgatggcagtattcggtgcatttgacgaaaacatcaagcagatcgagcgcgaactgaacgtctcggtcatcagccgcggaaccgagctgaaaatcaccggcgaggacgaaggcgtatctatcgctgcacgcgcgattacggcgctgctggcgatggcaggccgaggagaatccatcggcacacagaccgtgcagtacgtcatcggtttggcaaaggacggccgtgagagcgaggttcacacgatgagccgcgatgtgctgtgcatcacggccaagggcaagccggtcaaggcgaaaacgctcggtcagaaaaaatacatggaggctatccgcaagaacaccatcgttatgggcgttggccctgccggtaccggcaagacctatcttgcggtggcggcggctgttgcggcctttcgggacaagcaggtgtctcgtatcatcctgacccgcccggcggtcgaggcgggcgaaaagctcggctttctgcccggcgacctgcagagcaaggtagacccgtatctgcgcccgctgtatgacggtctgttcgatatgctcggcgcggaaaacttcaccaagtatcaggagcgcggctccatcgaggttgccccgcttgcgtacatgcgcggacgcacgctcgacgacagcttcatcattctcgatgaggcgcagaacaccacgcccgagcagatgaaaatgttcctcacccgactgggattcggctccaaggcagtcattacgggcgatattacccagattgacctgccggacggcaagcagtccggtctgcgcgaggcgctgcgcgtgctcgatggtgtggagggcatcgcccagtgcttcctcagcgaaaaggacgttgtgcgccatgagctggtgcagcgcatcgtcaaggcgtatgcagagtacgaaaacaaaaagggcaagggcaagcctgccgcaaaaccggcaggaaagcgccttccgacccgccgcagggagggaaaatgatgaatcatcagatcaatatcggctttgagaccgaggtagcggacgaaaacagcgtgcgtgagctcattcgcacctgcgcggagcgcgtgctgacgagcgagcaggtggactttgacgccgaaatcgacgttaccgttgtcgatgccgacgccatccgcgagatgaacgccgagtaccggaataaggatgccgtgacagacgttctctcgttcccgatgtacgaattcctcaacggtgagccgcaggaggagttggaggccgagccggactccggctgtgtcatgctcggtgatatgattttatgttacacgcgtgcctgtgagcaggcagagcagttcgggcactcgcctgcaagagagtgcggctacctgaccacacattccgtgctgcacctgctcggctacgaccacgagcgcaatgacgaggacactcgcctgatgcgcagcaaggaagaggacaaccttgcgttcctcggcctgacgcgggactgagccatgaaaaagaatatccgaaaactgagcgagagttttctgcacgccttccgcggcctgcggctgtgcatccatgacgagcgcaactttcgcgtgcacatgacggcggcgttctacgtcatcctgttcggcgtgttcggcggcgtgagcatgaccgaagcggccatcctgtgtatctgcttcggccttaccatgggcgcggaactgctgaataccgccatcgagcgcctgtgcgacaagcaggcgagcgggtatgacggcatggtacgtaacgcgaaggatatcgcggcggcaggcgtgtttgtgtgcgcggcagcgtgcgtcgcggtcggcgcgtgtatctttatcggaaacggcgtgcttgcagcagccatcaaatttttgtggtacaggctgtggcttggcatggcggttgtggtcaccgtgccgtttgccatttggttcgtttttcattttggaagaattcaataataatggagaatggatagcgacattttcaattttccattctcaattctcaattctcaattactgtactggagataaataatgagcaagattacaaaaactgcggtcgtatccgttgtgggacggccgaacgtgggcaaatccacgctgacaaacaagctggtgggccagaaagtggctatcgtatcgagcaagccgcagaccacgcgcacgcgcatcacgggcgtactcagccgcggtgaaacgcagtatgttctgctggacaccccgggtctgcacaagccgcgctcccgtctgggcgactatatgtgcaaggtggtgacggacacggtttccgaggtggacgttgccgttctggtggtagagcctatcccgaacatcggtcctgctgaggaaagcctgattgcacagatcaagcagcatcacatgccggcaatcctcgtcatcaacaagattgacaccatcaaaaaggaggagctgctggccgttattgcgacctacgcggcagcgcatgagttcgacgcggttgtgccgatctcggcacgcacgggcgagggcgtagaggagctgctcaccgaaatcgacaagtatgccatcgaaggcccgcagctgttcccggaggacatggtatccgatcagccggagcgtcagcttgtcgccgagattatccgcgagaagatgctgcgcctgctcgaccgcgaggttccgcacggtgtagccgtcggcattgagcgttggaacgagcgtgaggacggtctggtggagatcaacgcggttatctactgcgagaaggccagccacaagggcattatcatcggcaagcgcggcgcgatgctgaaagaaatcggccagcaggcgcgcgcggacatcgagcgcatgctggatgccaaggtattcctcgagctgtgggtcaaggtcaaggagggctggcgcaacaaccagtaccagatgcgcaacttcggctacgaggatcagtaaatggccgaggtcaagctgcgggcactcggtctgcgcgaggtggatttcggtgactttgaccgctatctgactgcactgaccgaggacggccgcaggattgaaatcctgtgcaagaacgcgcggcgcggaaaaaagcaaaatccggcggcacggcagctgtgttactcggagttcattctgtcggacagaggcggcaggtacaccctgcgggacgccgacctggtacactcgtttttcgcgctggcaggcgatattgagaagtacgcgctgtcgtgctacttaaacgagctgacaaccgctctgactgtgccggattttgacaatccggccttgtgccgtctgctgctgtacgcgctatacgcactcgagggcggcaagcgcgaccccgagcttgtcaaggcagctttcgagtggcgcattatggctgagagcggctacgcaccggatttaacctcgtgcggtgtgtgcggcgaggtgatagagaacccgccggtgtgcttttccgttcgggcgggcacagccgcggacgcaaagtgcgcggggagagtcggcggttatgcacagcttgtggacagtaccctgcgggcgatgcttcatgtgcttacagccgagccgaacaaggtctatgcgttcgcgctcaacggacccgccagagagcagttctgcaatatggcggaggaatatgtcaagtaccacctcggacgcgggtttgagagtctgcagttttatcggtcgctgcaggcgccgatgaagtgatggtatataaacgcgtagagaaatatacaatatttagaataatagtgtattcttctacgacattctacgcatttctacaccaatactcatctatcccaataaacgggtgacagaaaggagcagcagtatggatcgcaaagcagtctctatgtggaaggtaacgagaaatctgattcttacagacgtctgtgcgatcgccttgtactggctcataccgagcgcaaagatgctcgtgctgccgcttggtgtactgtgcgccgtcggatatatgctgtggctgggacggtgcttcctgaacgactgcaaggccaatctgccgaatgaggactatcagcgcattgccgccgagttcggctttatctggttctggaaccccggtcggagagaagagtggcagtacaccgccgaggaaagcggcgagaccggtgcggcgctgctgcgcatctggcgcgggaatatggtgcttgtcatcgtgtcgctggcggtcatggcggtgctggtttggatggggtaaacgtatagaaatttcgtagggttgcgtgggtatgtgaatgtatattggtaatccatcaacgaaaccctgcgcaataggttgaaataattcctaaattataattgagaggatttgaaatgaataaattaggcgaaaaatcccttaaaacactggaatactacgaaatactggaaaaactggccggacaggcggcatcgcaggcggcaaaggagaaatgccgcgcgcttcgtccgctggacgaccacgagcaggccgagctgtggctgcagcagaccacggacgcgaaggacctgatggttcggcagggcagccctgcctttggcggcatccgagaggtcggcgcgatcctgtcccgtgcggaccgcggtggcacgctcaacccgcgcgagctgctggctgtggcaagtctgctgcagaccgcgcgccgtgccctgctgtacgatgccgagcacgaaaccaagaccacgctcacgcctgttttcggtctgctctccggcaaccgcgacctggaggaatccatcacgaccgccatcatctccgaggaggagatcgcggacggtgcgtctcccgagctgctgagcatccgccgtgagctgcgccgcgtgtccggcaaggtgcgcgaaacgctcaaccgcatgatttccggtgagcgctccaagtacctgcaggagaatatcatcacccagagaaacggccgcttcgttgtgccggtcaaggtggagcaccgcggtgatgtgcccggtctggtgcacgatacctcgtccaccggtgcgaccgtattcgtcgagccgcagcaggtcgtggaaatcaacaaccagattaaggtgctcgaaggccgagaggaaaacgagatcgaacgcatcctcgcggagctgtcgtcgcgcgtgtccatgtacaagggcgccatcgagcaggactacgatgcgctgaccacgctggacttcatctttgcgcgtgccaagctgtcgttcgacatgaacgcctgtgcgcctgtgcttgttgaggacggcagccgctgcaagctgcttcgcgcgcgccatccgctgctcgataaggacaaggcggtgcctatcgacatcgccatcggctatgattacgacaccctcgtcatcaccggcccgaacaccggcggcaagacggtttcgctcaaaaccctcggtctgctgtcgctcatggctgccagcggcctgcatatcccggcgaacgagcagtcggaaatcggcctgtttgagcatgtttacgccgatatcggtgacgagcagagcatcgagcagagcctgtccacgttctccgcgcacatgaagaccatcgtgtccatcatggactgctgcgggcagggcgacctcgtgctgttcgacgaattgggtgcgggtaccgacccggtcgagggcgcggcgctggctgtcgctgtcatcggctatgcccgccagatgggcgcgtgcgttgccgccaccacgcactacgccgagctgaaaacctttgcgctgaccaccgacggcgtagagaacgcctcctgtgagttcgatgtcaagtcgctccagccgacctaccgtctgctgaccggcatccccggcaagtcgaatgcattcgccatcgcggcgcggctcggcctccagccgaccatcatcgagcgggcgaaggagcaggtttccactgaggatgcgcgtttcgaggacgttctggccgagctcgagcgcgaacgccgccgcgtggagcagatgaaagaggaagcccagcggatgcgctctgcggcgcagtccgagcgcgacaagatgcgcgccgagcgcgatgctgccgaggaccgtgtggacaagatgatggagagcgcccgcggacaggcggacaacatcctcaaaaacgcccgcatgacggcggaaaccgtgtttgacgagctggaaacgctcaaaaagaaggcgcagaagaagaacgccgaccagaacctcgcggcagccaaggcggcgctgcgcggtgtcatcacccaaaccgagaacgaacagcgccgcggcatccagaagcgcgttgtcgaggctgacgagattcgttcggtgcagaagggcgaccgtgtgcgcctgctcaacgtcggcggcgtcattgcgaccgtgctcgctccggcggacagggacggcggcgtgcaggtgcaggccggcccgatgaagatgacggtcaaggagaacgagctgcgcctcgtcgaggagaagaagaacgcgcctaagcccaagccgcagccgagaagagatgcgccgagacgcgaacttaacatccgctcggcagaaagcgaggttgatgtgcgcggcatgagcgccgaggaggctctctttgaggtggacaacttcctgtcgcgcgccatcatggccggactgccgtctgtcacggtcatccacggcaagggaaccggcgtgcttcgcacggctgtgcagcagcatctgcggaaaaacaagcgcgtcaagagcgtccgcagcggtgtttacggcgaaggagagcagggcgtaacaatcgtcgaattgcgttgaggaaatcccgcacagtttacgcatagatttcttttaatgaattatgtggtattgccctaaaaatacctgtttcaggaatcaaaaaccggtgaatagggcataatgccctataaattagtacgttttttgaaaaattcatctaaaaagcaaaggacacatatggaaataatccttgacgaaaatgcaaaaaagcgatagactatatacaacggatttgaagaaataggagcgatgcagatatgtattcaaaagaggtacaggttaccaatcaggtaggcttatatgcccgcccggcaacttttttcattcagaaggcaaatgagttcaagtctaccatcctggtagaaaaggaagagcgccgcgtaaacgcgaagagcctgctcggcattctgtccctgggtatcaccaagggcactaccatcaacctgatcgctgatggcccggatgaggaagaggctgtttccgcactggttgagcttatcacatccaattttactgactaagttatcgcgtcctgagggaaaagcgccggttgttttgatcggcgcttttatttttgcaaatgacgattgaggaaaggagggcagttcgcatgacaagagaacagctgaaggagcgcgtgcgcaagctgcccatgcagcccggcgtttacatgcacaaggataagaccggcaaggtgatttacgtcggcaaggccaagctgctgaaaaaccgcgtgtccaactacttccagccgcccgaacggctgaacgccaagacgcgccagctggtcagccatatcgacgacttcgatatcatcgtcacggacagcgagtttgaagccctcgtgctcgaaaactcgatgataaagaagtacaagccaaagtacaacattctgctcaaggacgacaaaggctatccctatgtgcggctggacaccacgctgccctacccggatttcaaaattgtctccaagcctgcacatgacggagcgcggtacttcggtccgtacatgggccgcggtgcggcaagacgagcgattgatacgatcggtgaagcactgcacctcaaaagctgtgcgcgttccttcccgcgggacatcggcaaggaccggccgtgcctgaatctgcacctcggccgctgctgtgcgccatgcaccggcaaggtcagtccggaggagtatcacgcgctgatcgaacaggcgatctcgctgttcgagggcgacgcaaaaaagctcgagcgtgaacttaccgagaagatgaacgaagccgccgaggaactgcagtttgagcgtgccgccgtcctgcgtgaccgcctgcgtgctatccagaagctgggcaccaagcagcatgtggttgccggtgcgttcgcagagctggacgttatcgcctttgtgcagggacagacccgcgcgtgcgtctgcgtgctgcattacagcgtcggcacgctgcaggataaggaatacacgttcttccacgtcaccgagagcgatcctgccgaggtgctttcctcgttcatcaagcagtattacgcgcagcgcaatgcggtggcgaaaaccgttttgctctcgcatgaaatcgaggagcaggacgccgtgggcgagtacctttcatccatcgcagagcgcaaggtcgagctggccgtgccgcagcgcggcgaacgccgggtgctgacacgcctcgcggagaaaaacgccttcgaggagatcgaacgcagagagaagcagtccgagagacggcataaatcgcttgaactgctgcagaatgtcaccggcatggcggcgctgccgcttcggctggaagcctacgacatttccaacttcgccggacaggatacggtcggctcgatgatcgtgtttgtcgagggtcagccgaaaaagagcgattaccgcaagtttaagattgcgtgtgccgccaacggacaggacgactacgcctccatgcgcgaaatgctcacgcgccgcgtgcagcgctatgtggacggcgacgagaagtttgcgccgctgccgaacgcgttcatgatcgacggcggtctgggtcatgtgcacgtctgcaaggaggtgctcgactcgttcgggctgtcggttccgtgcttcggcatggtcaaggacgaccatcaccgtactcgcgcccttgtcgcgccggacggccgtgagttcggcatttcggccacaccggcgctgttcgcgctcgtcggccggatgcaggaggaggtccaccggttcgccatcgagtataatcgcaagctgggcggcaaaaaggtgcgcggctccacactggataaaatcccgggcgtgggcgataagcgcagaaccgacctgctcaagcacttcggcagcattgagaatatcaagcaggcgtccgagcaggagctggcgagaattctgccgaggaatgccgcgcagagcgtatacgaattttttcataatgagtaattactaattcctaattttcaaacagttagatttcagcaggaggctaccatgagagttgtatccggaactgcgcggggctgtaaattgcagcccgtgcccggcatgaacacccgcccgaccaccgatcgggtaaaagaaaacgtattcaatctgatacaggatcatgtgcgcggtgccgaggtgctcgacctgtttgcgggcaccggtcagcttggcattgaggcgctctcgcgcggcgctgctcactgcgattttgtcgagcacaacaagaccgcttacggcatcgtgagcaaaaacgtcgaaagtgcgcgtgtgaaggataaggcggcgctccaccgcacggaggcagcggaatttgtttccaaagcaggcagggaacggtacgacgtgatcttcctcgatcctccgtacggcggcgtgatcttagaaaatgcgctgaaacagatagaaacgtttgacattctctctgtaaatggtataataatatgcgaaagtgcagtagaggacagattctcccacggcttcgcggtcgtgcgggaacgccgctacggcgctaccatgattaccattctgcagcggcagagtggcgaaacggaatgaaataaatgaaaattgcgatttatccgggcagctttgaccctgtcacactgggacatctggatatcatccgccgtgcgtcggtcatgtttgaccggctgatcgttgcggtaatgcacaaccagaacaaaaaacccgcttttaccgccgaggaacgtgtggaattcttaaagcggacaacggctgacctgccaaacgtcgaggtggaatccttcgacggcctgctggcggactacgccaagcagaaaaacgcatgcgccatcgtaaagggtctgcgtgcggtttcggattttgaatacgaattccaaatggcacttgccaaccgcaagctcaaccctgagctggataccgtgtttttgatgacaagtgcggaatatatgtacctctcttcctcgatcgtgaaggatattgcggtacacggcggcggtgtcgccgattttgttcccgaggggattatgcaggacattgtgcgccgaattagaaagggagagtaaaaatggcaactttagaggaactcattaaccgcatgtatgatatggtgcaggatgcaaagggcattccgctggcaggcgagaagtgcatcgtagagcgcgaccacatgctggatatgctggacgagctgcgtgaggctctgccgaacgatctgcagcaggcacaggaaattgttgcaaagcgcagtgagatgctggcatccggtaagcgcgaggctgaggcgatccgccgtcaggctgaggaggatgcacgccagatggtctccgagactgagattgtcgtagcggcacgccgtaaggccaaggaagtacagggcaatgccgagattcaggctcgtgagctgcgccgcgtggcaaatgagtactgtgaggataccctcaagcgtaccgaggaggcagtagctctcggtctggaggaggtccgcaaggcacgccagcgcttcaagagcatcgcaaagtaaaaacgaaatgcaggcagtcaccttcgggtggctgctttttcgtgttctttgcggtaccggcacaacaggaattctgcgcagcctttctcggcacagggtgactgggagacacgaactgcgtgagcgtgttcgtttctaacgggcgggagtttttcgccggataggcgaacggttcttgcctgcgcggcgggcgcacaagagggtagacaccaaggtttccaccctcttgtgaatcacccctttcctaagagagtctggcgcaaaccagagagcggcgaccgctgcgaaatagaggaacggcagttgggttaccgttgcgtgcctttcgtgaaaaatttgcagttcacagacagcgtactgctacacatatcggcaactctacgctgggtgcggtatgacagtgccgcacaattcgcttacgcgttgttgcggacggcacctgcgaattttatttgataacagccgtcaccttgtctgcaccaccccatcacccactcctcaccaccaacgccgaaaaagagaacctcacacccactttacgccaccgtgctgaaaaatgtccggctgaaattgcacaaaaatacacactctgtggataaactttgggataactctccacttcacagtaaaatgcaggaaaacaccgcgcacgaatacaatcgaacaactgttcgcaaaaattgcgaaaactataaaatttgcaagaaaaacgcccgaatttttcgtgcaataatgcaaaaaatatcttgcaatctattctccgtaccgctataataaaatcaaggtggagagatgtggggtaaagtgtcacgaattccaccaaagcggaagggcaggtgtgaatgagtgaagggcgaatacaagcattccatagacgctaagggtcgtctggcaatgccggccaagctgcgcgaggagctcggcgagcacttcacggtcaccaagggcctcgatggctgtctgtccgtctatccggaagcggaatggaagcgtctggaggacaagatccgcacgctcggcaacggcgaaaaggcaagacgcgtcaagcgctactacttcgccaatgcgttcgatgcacagctcgacgcacagggccgtattctcattcccgcaaacctgcgtacctttgcggagctgcagaaggatgttaccgtgatcggtcagctcgaccacgcggaaatctggaacagcgacaagtggcgcgcttacaatgacgagatcgacgcggaggttgttgccgcggacgtagaagatattgatttttaacaaaagggcagggaactatggaatttcatcatgtatccattttacttgagccttgccttgaggctctgcagatcaagccggacggcgtttatgtggacgccacgaccggcggcgccggtcactcgctccgcattgcggagcgtttgcatgataccggccgtttgatctgtattgacagagatgacgaagcactcgaaaacgcgaaggaccgcctcaaggatgtatggcagcgtgtcacaccggtcaagagcgacttccgcgatatcgacaaggtgctcgaagggcagggacttgcaggtgcggacggcattctgttcgacctcggcgtttcctctccgcagctggatcatgctgagcgcggtttttcctatatgcaggatgcgccgctcgatatgcgcatggaccggcagcagaagctgaccgcgtatgatgtggtaaacggctggagccgcgaggagatccgccgcattctgtttgagtacggcgaggagcgctacgcaccgctgatcgcagcggcgatcgagcgcgaacgcgcagacaagccgattgagaccacgctggagcttgtccgtgtgatcaagggcgctatgcccgcgaaagcactgcgcgaaaagcagcatccggcgaagcgcagctttcaggcgatccgcattgcggtaaacgatgagctgggtgccgtgcgggaagcgatggaaaaagctatcgactgtctcaatccgggcggcagactggcggtcatcaccttccacagcctggaggaccgcatcgtcaaggcggcttttcagcaggcggcacagggctgcacctgtccgaaggactttccggtatgcatctgcggcaaaaagccgaaggttcggctgacgccgcgcaagccgattctgccggacgaaagggaaattgaggagaatccgcgcgcccgaagcgcgaagctccgggtttgtgaaaaaatctaaaccgaaaaagcaaattcaaaagaaaggaaagcgcaagatggcttctggcaggaacaacgcggcaagaaaatatgaagatcaggttcctgtacagcgtgaggtacagccgaaacgccatctgcaggtagcggcagcaccggtcaagaaaaagaagcaccgccgcaagcctgctgtgatgcagggcgtgtacccgtgcatttttctggtggcgattacggcggcgtttatcctgttctgccagatgcagctgacccagcttaccgcggaagcgagtgagcagagcgacctgctcagcgagctgcagtcggagaatgtttctctgacgaccaagcagatgaacagcatgaacatggatgaggtagagcagtacgccacggacacgctcggaatgataaagctggacaattcgcagatcgaatatgtggagctgaccaatccggatcttgtcaccgttgcagacgacagcatgacgctgcgcggtctgtggagcgcactggcagcgcgcttttccgcacttgtggaatatatccgataagcagttgaatacaatgcgtacaggggagtgagaggtggataacttctgactccttacgctttttcaggaacaatatggaggctgactaaatggcagttaagggacccaaccatcaaatgcgcacgcgtatccgcgggctgaccgtgctgtttgcactgatcggtttcgggctggtaggcgtgcggctgctgtatatgcaggtattcaatcacgatttctatgtgcagcaggcgacggcgctgcagacgcgcgacacgttcatcacgcccaaccgcggcaagatctacgacgcgaacatgcaggttctggctgaatccgccgccgtagagcgcattacggtcgatccgaaggccgttgtggacgagaacaaggtcaaaaagggcatcacggcggaaagtcagcagcagacgcttgcgaccatcctgtccgaaacgctggctgttgattacgataccgtgatggaaaagatccagaagacgaactcgcagtacgaaattatcgcgcagaaggtcgataaggacgtatccaaggagctggatgagaagctcgaagcggcagactgcaccggcgtctactccgagccggataccaagcggtactatcagcatggcgccttcctgtctgcggtgctgggatacgtcggcagcgacaacaacggcgcatacggtctggaatccgagtacaacgatgaactggccggcaccgccggacgactggtccgcgtgcagaatgcacagaataaggacattatgccggaaacccagcagtacattccggcgaccgacggcaactctcttgtgctgaccatcgacagcgatatccagaactatctggaaaagcaccttgagaccgcacttgccgacaatccggaggcgcgagacggcgtttccggcatcgttatgaacgtcaagaccggtgaggtactggcaatggccaacctgccggactttgatccgaacgatgcctacaagctgacgagcgaaaagtatatcaacgaactcaagaaaaatgttgcgaaaatcctcaaggaagagaacgtcaaggtcgaaattccggatgcatggtatacggaaggcggtctggacaatctgccggaggcgattcatgacaattccgatctggtagatgcgctgggcagcgcccgcgtgaatatcctgatgaaaacctggcgcaatccggttatcgcggataactacgagccgggctccaccttcaagctgatgacggtctccaccgcgtatgatctgggtgctacccatgccgaggacacctactactgcggcggctccctgcaggtggagaactgggagatcaagtgtgcaaatacaagcggccacggcatgcagacgctgaccgaagccctgatgaattcctgcaacgtagcgatgatgcagattgcccagagcgtcggcatggatcggttttacaacttttacaaggcgttcggcctgaccgagccgaccggcatcgacctgccgggtgagggcaagggccagttccacaagctggatgttgccagtgactggaacgaagtcgcactggcgaccgcatcgttcggtcagcgcttcacggtaacgccgattcagatgctgaacatggtctgcgcgattgtggacgacggcaagctgaaaaagccgtatgttgtcaaggaagtgctgggcggagacggttcggtcaagtctacgaacgagaccgaggtggtccgtcaggtcatttccgaggatacctccgcttacatgcgcggggcgatggaacaggttgtcgcaaacggcaccggcaagaacgcgtatgtgcccggctaccgcgtcggcggcaagactgcgacctccgagattcagcccgaatacgacagtgacggcaaggtgctcgataccgaggaccgctacacggcctccttcatcggcgtagcaccgatggacgacccgcagatcgcggttctggtcgccatcaacgacctgccggaatccgcaacgcataccggcggtacgatcgccgctccggttgtcggccgcatcatggaggatgtgctgccgtatatcggcattacgccagtctatgacgacagcgagagcgaccgccgcgagctgaccgtaccgagtgtatccggcaagacacgcgacgatgcgatttccacgctgtccgacgcaggctttgactgcatcattaagggcgacggcgataccgtcaccgatcaggtgccgaatgcaggcatgcgcattgcggccagcggcaaggttatcgtctacatgggcgaggaaaagccgactgaggccgttgaagtgcccaatctgtccggcatgtcgccggatgagtgccgcgatacgctggaggagtacggtctgtacctcaagcagaagggtgtttcgtccgcgcagatcacaggcgacaccaccgcgaccaagcagagtccggaggccggtaccaaggtaagcctcggtgcggttgtcacggtagaattttctgatacaacgacggtcaacgaccgataggaggaaattatgaaattacaggaacttttgaaggatgtagcagtgaaaaacagcactgccgcacaggatatcgagatcaaggaagtgcgttacgactcccgcgcggtacagccgggcgacctgtttgtagccatccgcggctacgcgaccgacggtcacaagtacatcgccaaggcgatggagcagggcgcggcagccgttgtctgcgaggaggcgccggagggcgtccccgcagtcgttgtggagaattcccgtatcgcgctggctgagattgcggcaaaccgcttcggtcatccggcagagagcatggtcatgctcggtgtgaccggcaccaacggcaagaccaccacgacctacctcgtcaagcacatgcttgaggacgcaggccacaaggtgggtctgatcggcaccaaccagaacctcatcggtgatgaagtgatcgaaaccgagcgcaccacgccggaatcctacgagttgcacgcactgtttgcccgcatgagagacgcaggctgcacgcatgtgatcatggaggtttcttcgcactccttggtgcttgaccgcgtacacggcattccgtttgcggtaggtgcgttcaccaatctgacgcaggatcacctcgatttccacaaaaccatggaggagtaccgcaaggcaaaggcgctgctgttctccatcagcaagaagggcgttatcaatctggatgatgctgcggcggagaagatgctcgcggacgcaaagtgcccgtgcatgacgttctcctgcggcaagccggaggccgatctcgaagcgaccgacctgcagctgcacgcggacggcgtggagttcaccgcacagtatcagggcgaaaaggcagacgtcaagctgccgattccgggttatttctcggtcgagaatgcactgaccgcgctcggcatcgtgctgcagctcggcatgccgcttgcggatgcggcgaagtccatggcaactgcaaccggcgtcaagggccgtgttgaggtcgtgccgaccgatacggattacaccgtgctcatcgactacgcacactcgccggacggcgtggagaacgtgctcaaggccgttcgcggctttgcaaagggccgtgtcgttgctctgttcggctgcggcggcgaccgtgaccgcaccaagcgcccgaagatgggtcgcattgcggctgacctcgcggacttctgcgttgtaacgagcgataatccgcgcaccgaggagccgaaggccatcattgatgatattctcgagggcatgaaggattcggatacgccgatgcaggtcattgtcaatcgtccggaggcgatccactgggcacttgcacacgcacagaaggacgatatcatcgtgctgatgggcaagggacatgagacctatcaggaagtaaaccatgtgaagcaccacatggatgaacgcgagattgtagcggaatatttcgcgtgataggggacttcaaaagtcccctatctacggagaacggttcctaaggaaaccgttctccgaaacccgaatgacgctcggcgctatccttgcgcggctttgctgccgcgctgcgccccaaggcggatgggtcgggaaataaaaaccgagcgttatccttgcgcggctttgttgccgcgctgcgcgatacatgctcccggtttttatgaaattgcaggcaatttctaattgaataccatgtgcaagcacatggtcgtctgcggacgggaacaaagacacggttttccgaaaggaaaacctgtcttaatgtaagccgctgcaagcagcggcgagatttgataattattgggggaaacggcatggaacgatttacattagcgcaggcggcggcatggacacacggcgaagcgagaggcgaggcggctctgacggcagtcacgaccgattcgcggcagatcccgccggaggcgctgttcctgccgatcaagggcgagcggtttgacgcgcacgatttcatcggcaaggcgatcgagaacggcgcggcggcagtcatgagccatcgcgaaaacgaggaatatccggtgccggcgctgtacgttgagaacacctcgcaggcgctgctcgatcttgcgggcggctaccgcacgatgtgcggcggcaaggtcgtcggcgtaacagggtcggtcggcaagaccaccaccaaggagctgctgtatgccgttctctcgcagggcttccgcgcacagaagacagaaggcaacctgaacaatgagatcggtctgccgctgacgctcatgcgtatgacccgggataccgaagtgctggtagcagagatgggcatgaaccatttcggtgagctttcccgcatgacggcggctgccaagccgaatctggcggttatcaccaacattggtacctcgcatatcgagtttcttggctcgcgtgagggcatctgcaaggccaaactggagattctcgagggtctgcaggagggcggcgcggctgttctctgcggcgatgagccgcttctgtgggacaaacgcgagaacctcggctgcaaggtggtaacttatggcatcgaaaattccgcctgcgacattactgcggacttgcacagcgacggtacatttgatatagtaaataacggtcttgccgcggcacacctgccggtcggagagaaattcaccgcgaagctgagtattccgggcaagcataacgtgctcaatgcactggcggcggcagctgtcggtctgctgctcggtgaaacacccgagctgatcgcgcagggacttgtcagctatcaggcaagcggcatgcgccagaacatttatgagcaggatggctaccaaatctatgcggactgctacaacgcaagtccggatgcgatggaggctacgctgtccgtgctcggcggcatggccggggaaggccgccggtttgcggttctcggctcgatgctcgagcttggcgattacgccgaggaaggtcatcgccgtgccggtcgtgcggcggcgcagtacgcggacgccctgtacgcctacggtccggatgcagcggccatggtagccggtgccagggagaagggcatggagcatgcgtatgcgttcgacgaccagaccgcgcttgtcgcggcactgcgcgaggacgcgaaaaaaggagacgcgctgctgttcaagggcagccgcggcatgcgcatggaacgcgcacttgcaatgtttttaggggaggaagttgaagcatgaaacaggctgtgcttgttttcgcgatcgcactggtgattacgctggctatcggtccggcggtcatcaattatctgcgaaaaatgaaattcggtcagaagattctcgaaatcggaccgaaatggcatatgaacaaacagaatatcccgacaatgggcggatttatgttcattatcggtatcgcggcggcagtcattatcggcaatatcgtgatgggtgagatttcggtctcgtcgcttgcggtgctcggccttgccgtggcctacggtgcggtcggtctggtcgatgactacgctaagatcaagaaaaaggaaaacgcaggtctgaccccgaagcagaagctggtgctccagattctggttgccggcgtgttcatcctcgtactgttcctggggtcgagcggtctgccgcagctgtggattccgttcacgggcatttcgttcagctggccgtggccgctgtatatcgtgttcgcggcgttcgttatcgtcggcgcggacaacgccgtcaatctgaccgacggcatcgacggcctggcggcaagcgttacgctgccggttgccatcttcttcgtgttcgtcggcttccgccgcggagacatgggcgttgtgatcttttcggcggcactcgcgggtgcgctgctgggcttcctgcgctataacttcaacccggctaaggtgttcatgggcgataccggctcgctgttcctcggcggtgcggttgcgggtctggcatttgcatgtgaaatgccgctcattctgctgctggtcggcctgatctacatcatcgaaacgctgtccgttatcctgcaggtcacctacttcaaggcgacccacggcaagcgcctgttcaagatggcgccgatccaccaccactttgaaatgtgcggctggggcgagaagaaaatcgtgctggtattcaccggcatcacggttgtgctgtgcctgctggcctaccatgtggcactcgcaccgctgttttaattcgtaattcggaggtaaccctatggcttcgacaactggaaagacgaatccgcagtaccggccggcgtcgcgccgtcccatgccgcggaatgcgccgagcggcaaaccggcgcgtccttcgcgggagccggtgccgcaggagcgttaccgtaccggcaccgcaaagccgaagcgcagacgcatgcgcagcatgaaggcgcacatctgggataccggtgtgttcttctcggtgctgctgctgctgatcaccggtctgatcgcgctgttctcggcaagctataccaacgcgatgttctacaagggcagtgcgacatactttatcatgcgtcagggcattttcgctgcgatcggtcttgcggctatgatcgcactttccaagtttccgtaccgcatgtacgcgggcattcacaacatcatcatgtggatatcggtcgcgctgctgattctggttgcgataccgggcatcggcacatcgatcaataatgcacgccgctggctgttcggctttcagccgtccgagatcgcaaagctgacggtcatcatctgcttttcctactgggtggcgcgtgacccgaagagcgtgcgcagcgtcaagaccatggtgcagccgtacggtctgctgctggcgatgtacatcggtctgctgtacctggagccgcatacctcggcgatggtaatcatctgcggtatcggcgttatcatcctgctggcaggcggcatgcgcctgtggtactttgcgccgattctgggactgggtgcaggcgcggttgcagcattctacgttgcgtttccgcatgtacgaacacgttttgaagtctggctcaatccgttttcggatatggcggacaaaggtctgcaaggctcgatgagccagatcgccatcggctcgggcggtctgctcggccgcggactcggcaacggcctgcagaagcagctgtacctgccggagccgcataacgacttcatctttgccacctggtgcgaggagatgggtctgatcggcgctctgctggtcattctgctgttcgcgtatctcatttaccgcgggttccgcgtggcgcgttatgcaccggataaattcggcagtcttctggcgaccggcatcactgccaagctggctatccagacgctgatgaacctgttcgttgtcaccggcatcatgccggtaaccggtgcggctctgccgtttttcagctatggcggcacagcgctgatgctgcagcttggcgagatgggcatcctgctcaatatatcgcggtatatgcggattgacggaagaaatcaggattaagttatgcaaatcagggctgtttgcagcatacaaacagccttgtttgcggctcacggtactgtcaggcagtaccacatgatccggtaaacaggatttgccggaccatgtgatcctaccttgcatttgaaaagtaacaaacaggagaggggaactcagttttgaaactgtacattacgggaggcggcacgggcggtcacgttacaccgggtcttgccattgcacgctattttgaaaaaaagcagccgcagacgacggtgcgttttgccggttcggcacgcggcattgaaaataagctggtcccgcgtgagggatatccgctggacaccattgagatcatcggcatgtcgcgctcgatgagcccgaagggcattctgcacaatctgaaggcggcaaagctggctgtctcggcggtcagcaaggcgaaaaagctgttgaagcaggccaagccggactgcgtgatcggctgcggcggctatgcgtcgttcgcggtggtacgcgcggcacagcagctcggcattccgaccgtgctgctcgaggtcaacgcgctgcccggcaaggtaacgcagatgctcgcaaaggacgcggaccgcgtactcgtttgctttgaacaggcaaaggagctgctcggcggcggagataagatcattctgaccggtgcgccggtgcgcggtgagattctggcggcggaccgcgtaaaggcacgcgagaagttcggcctgaccgatgatgaccagctggtcgtatccttctggggctcgatgggtgcaaagtacatgaatgagcacatggcgggtgagctggcgctcgaatgcaaaaacggcgtgccttatcaccatgttcacgcaaccggtgcggcggcccgtgagtggctgcccaggatggcgaaggagcagggcgccgactttgacgcgcacccgaacatcgaagtgaccgagtacatctacgacatggcagaccgcatggcggcggctgacctgatcgtgtgccgcgcaggtgcggctaccctcggtgagctgtgcatgctcggccgtccggcactgctggtgccgtctccgtatgtggcggagaatcaccaggagaagaacgcgcgcgcgctcgaaaaggagggcggctgccgtgttctgctcgagaaggacgccaatccgcaggtgctgtacgacgagattcaggatctgctgagcgaccgcgaccgtctgcaccggatggggcatgacgcgacaaagctggcggcgcacgatgcaagcgagaagatctatcaggagatcctctgggcaatcgaaaaccatggcaagaagtaacaaagaagggatgctgtgatgagacgcagaaggcgaaaaaagcacacgcccgaccagatggagcagcagcgccgcggcaggaaaatctttcgtgtgctgggacgcgtgctgctgaccggcattgtgctggcggctgccgtggtggcgatgaccgtgttcttcagggttaagaccatttcggtggaaggtgccgagcagtatggctcggaggagctgatcgccggtatggatgttcaaaagggcgataatctctatctgtggaacaaaaaccgcgtattgtccgatctgatgcacagcttcccgtatctggaaagcgcacagctgcgccgcaagctgccggatggactggtgctgactgtcaccgagtgcacagcggcggctgccgtgaggaatgaggataacacgttcacttatatcagtgcgggcggcaaggtgctcgagaacaacgccgcggacggcggtctgccgaccgtgctcggcgttacgctgaatgcgcagattggggatttccttgctaccggcacggatgcacacgttgacgctatgctgaacgtgctggagaacatggatgccgccgggctgctcgaaaagatgagcttcctcaatctgaacgacctgaccgatgtgcgcatcggctatgacaagcggttcgacatccgcgcaggttcactggacgatctgacataccgtcttcggtttgcacagaccgttatcagcgatcgcctttcggcatcggatatcgggcggctgtactgggatgcgcagaaccgtctgcactttgtgccggagacggcggaggatgtagcacgctccggtaccgatcaggcaggtgacaatccggtgacctcgccggcatacaccaatccggacggcgaagtcggtacgaccgacaatacgaacggcgatgactcgaccgattcgagcagcgacagttcggacagttcggacagttcggataactcggattattccgatgattcggattactcggacgattcgtcctatgacgaatcctacgatgacagcagcgacgatgattcgtacgacgaatcgtatgacgatgacagctattatgacgacagctacgatggcgaaggctgagttttttctgcttctactggcgaaaataaccgaaaacacaggaaaaaacgcgaaaaaatacagcctttttccgtatcgcccgccggtttgcgggaaagacacggaaaagattaagttttttttgaggaattcgctaattcctgttgcaaaatagaataaatcgaggtaaaattaaaacaataggggcgaagtgccctcaaacgcggtaattgataatcaaagaacgattctttatcataaaacggaggacaacgacaatgggttttgagtttgaacagggcttggataacgtagtaaacattaaggtcatcggtgtcggcggcggcggcggcaacgctgtaaaccgcatggtcgagaacggtgtacagggtgttgagttcgtttccatcaacacggatatgcaggctctgaattattcgcaggccaccacgaagatccagatcggcgagaagctgaccaagggtcagggcgcaggcgcaaatccggagatcggccgcaaggctgctgaggagagcaaggatcagatcgcagcggctctcgctaacaccaatatggtatttatcaccgccggcatgggcggcggcaccggcaccggcgcagctccggttgttgcacagatcgctcgtgagctgggcatcctgacggtcggcgttgttacccgtccgttcgcattcgagggcaagaagcgtctcgagcaggcgctgagcggcatcgaagagctgaacaagaacgtagactctctcgttatcatcccgaacgagcgtctgaagtatgtatccgagcagaagatcaccttcaagaacgcattcgagatcgctgacggcgttctgcgtcaggcagttaagaacatttccgagctgatcactgttccgggcttcatcaacctggacttcgcggacgttacctccgtcatgaaggacgcaggcttcgctcacatcggcaccggctccgctgcaggcaaggacaaggctgcagaggctgcacgcgaggcaatttccagcccgctgctcgagacctccatcgacatggctcacggcgttatcgtttccgttatcggctctgatgatatcggtctcgacgaggttgagactgcagctaccatggttcagcaggcggctcatccggatgcacacatcatcttcggtgcattcatcgacgagaacatggacgacgagatccgcgttgttgtaatcgcaaccggtttcgacaatgttccgaactccgcaaagatgagcatggacggcaataaggacaaggcttccggctccaccggcctgttcaccgaggctgctaccgcagcggctgacaagaagccggctcgcgcaaccgcttccaagccgtcgtccgatgttggctctgacgatgctgcatttgatgttctgatgcgcatcttcgataaggacaaccgataatctaactgatagctattcaaaacagcccgtaacagggctgttttgtcaggtatgggtaggttaattttagatgaaatccatattaaaggagagtgatcaccgtgagtacggaccctggaagtagacagatgaatattactcgcggtggcattttcgaggagtgccgctgctgaaaggcggtataatatggttgaatttttcaaaacggtggacggccgcatcacagaagtgagcgagtttaccgagggctgctgggtcaacatggtgcatcccagctcggacgagctggagcagatcgcgcaggcggctcaggttgaggaagagtttgttcgcgcggcgctcgacccggaggaaagctcgcgtgtcgataccgaggacgagcagcttctcatgatcgtcgatatcccgatggtggagaaaagttcggtcgaggacggcggacagatgttcaccaccattcctatgggtattgtcgtggcgcagaatgcggtcatcacggtttgtctggaggacagcatcatcctgcgctccatcgcggaaggcgcggtaaagggcgtgcatacctcactcaagacgcgctttgtgttccagattctgctccgcatcgcgggccggttcctgaaaaacctgcgtatgatcgagcgcgactttacccgcatcgagaagcgtctgtacgactccctcaaaaatgaggagctcatccagctgctcggcctgagtaaatcgctggtttacttctcctcctccctcaagggtaacgaggttacgatggaaaaggtgctgcgcggccgcgtgctcaagctgtatgaggacgaccgcgacattctggaggacgcgctgatcgaggtccgtcaggccatcgagatggcgaatatttattccaacatcatggcgggcacgatggatgcttatgcttccgttgtttccaacaatctgaatatcatcatgaaggttttgaccatcctgaccatcatcatgacgattccgaatattgtgttcggcttcttcggtatgaatatcggcgaaggacagataccgggcgactgggtctggtggatgccgctggccattacagtggtaggctgcttctttgcatggtggatgctgaagaagaaaaatctggactgatacaagctgcgcttccgagaaatactcggaggcgttcttttttgccttctgtacgcatagaatgaaacaaaagcaggagggacaatgccatgatcgtttttgcggcaaaggtgtcggtgaggaaaatcgtagtgggcgtgctggcggtcgggctggtgctggtcggcgcggcagcgctgctgccgaaaacggcagaggcggatactgcggtcagcgctgaaggtgcagcgcttagtgcaaagctgaaaaccaacgaggacagagtagcgctgctgaccgcatgcggctggtcggtggagagtgaaccggtcggcacacaggaggtgcagatacccgacaccttcgacgaggtatatgagcagtacaacgctatccagcaggcgcagggactggatctcacgccgtatcagggcaagcgcgctacgctgtacacctacgcgctgaccgcctatcctaccggagagcagggcgtgactgccaaccttttggtgcgcagaaaccgcctgatcgcagcggatatcacatccgcacagacggatggatttgtgcatggcctgctggatatgccgcagacctgacagcggcgggcaatgacttccggaaactgcataactgtgcaattcaacgaaaaagttatcataggtttatggtatctattggtaactttcgggggattgcactttttttgcatttagctattgtgcaatttgcgaaaaagtgttatccttataaaagaaatgtattggcggaggggacaaaatgccacagatgcgattggacaaattgctgtcccacctgaactgcggcagccgcaaggaagtgcaggcgctcattcgtgcgggacgcgtctcggtggacggcactgtgcaaaaagatccggcgttcaaggtcgatcccgaccggtcacagacggcggtggatggcaccgtgcagcgctaccgcgcacagcggtactacatgctcaacaagccgatgggcgttatcacggcaagccgcgatgagcgccacgataccgtgctcgagctgtttccggccgagctgcggcgaggcctgtttgcggtgggaaggctggacaaggacaccgagggattgctgctcatcacggacgacggcgcactcagccatgcgctgatgagtccgaaccgccatgtcgaaaaggagtacgaggcggtcgtggacggcgcactggcagcggatgcagtcttgcgttttgaacagggcatgaccctgcgggacggcacggaatgcaagccggcgaagctggaaatcctcgagaccgaaccggagctgcgcgtgcgtgtgacgcttaaagagggcaaatatcatcaggtcaagcgcatgattgcggcagtcggcggcacggtaacggcgctaaaacgtctgcggctgggtggtctctggctgggtaaaacactcgcgcccggcgaatttcgggaactgacacaggaagaattggaaaaacttacctcgcaaacctgaaaaacttaaaaaatctacaaatttttttgaattttttgtacaaaaatgcgcggacatgtgatataatgacttaaaatgtatagggaacttttggcgttcttgtgaagaatgtcataggcagaatcaccattagcggtgagaacgccataaggagtaagcgtttcggcggacagatgcggagtaaagcgccggggcgcgtgaaaaagacgggaaaggtgatggaaatggcttcgagattgttccagtcgattgttttgcagatgaaggatacggtggatcgtacgatcggcattgttgacgcaagcggtgcggttgtagcatgtaccgatctgcctcgtatcggtgaaatgcgggaggaagcaatcactgagctgggcttcgccggcgagatcgttcgtttcggcggttatacttatcatacaacgggtgaccgtgcgtcgcgtctggaatacgctgtattcgtacagggcgaggacgagctggcgcgcagcatctgctcgctggttgcggtttcgatcaacaatatcaagacgctgtatgacgaaaagcacgacaaggctaccttcgtaaagaatatcattctggataacatcctgccgggcgatatttatatcaagtcccgcgagctgcacttcggcaacgatgtgccacgcgtggtattcctcgtgcgccagcaggcgccggccgatgttgccgcgatcgacgtggtaaacggcatgttcccggacaagcagaaggatttcgtgctgcatatctccgagacggacatcgttgtagtcaaggaagtcaaggcaggcagtgagatcaaggatctggtcaagctggcagactctatcgaggagacgctgctcagcgagctgtcggtcaagtgcctgatcggcatcggctcggtatcctcccagatgaaggatatcgcaaagtccttcaaggaggctacgaccgcaatcgaggtcggtgcggtatttgacaccgagaagaacatcatcagcttcgagaatctgggcattggccgtctgatttatcagctgccgattacgctgtgcgagatgttcctgtccgaggtattccgcaagggttcgatcgactcgctcgatcaggagacgctgttcacgattcagaagttcttcgagaacaacctgaacgtatccgagacctcgcgtaagctgttcgtacaccgcaatacgctggtgtaccgccttgagaagatcaaaaagctgaccggtctggacctacgtgagttcgatcacgcgatcgtatttaaggtagcgcttatggttcgaaaataccttgcaagccgcgaagaaggtaccagataatcgctgtctgttcataaaatctacacagaaaaaacgtaaattgtgcaataatgccacagtttgtcggcttgcgcataaacatgatatctgttataatagacaaaggtgtatatgtttacacctttgtcttttttgtttgctggaaggcgaaaatgcccaatccggggcattcgcacgccttctgcgttggcaccgaggaggattgcctgtgatacgaatgagtgaagccaccgtggtttacgaaaacggaacccgggcggtgaacaaggcgagtctgcgtgtagacgagggagaatttgtctttctggtcggtgcgtccggctcgggtaaaaccacgatcatcaagctgctgaccggtgaggttcggccgagcgaaggccgcgttatcgtcaacaactacgatatcggcagaatgaaaaagcggcagattccgtatctgcgccgtacattgggcgttgtctatcaggatttccgcctgatcaacaccaaaaccgtttacgagaacgtcgcatttgccatgcgcgccatcggcgccaagggcaaggccatcaagcagcgcgtgccgtatgtgctcgatctggtcggtctggccgacaaggcgcacgagaagccgatgaatctttccggcggtgagcagcagcgtgtcgcaatcgcgcgtgcgctggtcaacaacccgcgcctcatcatcgcggacgagccgaccggcaacctcgatcctgcgcgttcgctggagctgatgaccctgtttgaaaagatcaacgagcttggcacgaccgtgctgatcgtaacgcacgaaaagggcctggtagacgaatttgaaaagcgcgttgttgtgatcgacaacggtgaagtcatcagtgatcagacaggtgggtattatcagatatgagatcaatcgcttactattggaaggaaggcctgcgcaacattttcaagcacggcttcatgtccgtggcggccgtggtgatcatggtcgtaagcctgctgctgacaggtacggttacgctggtggcctacaacattacgaataacattacgagactgcagcagtccaaccagatcgtagtctggatcgacgattcgcttaccacgcgtgaggcgaaaacgctgcagacgcagttcgagaagattgacaacattgcgtcgatcgccttcgaggaccgcgatgtcgcgctggagcagtaccgcaaggagctgggcgacgacgcagacatcctcgatgattataacgcggacaacaatccgctgcgcaacagctatgtgttcaccctgagtgattccatgcaggcggacgcaacgatcaaggaaatcgaagcggttgacggcgttgcaagcgtgcgtgcggatgaggatgttatccgcaagctgattcagattcagcgcgtgttcaacatgatcgcggcagctatgatcgtcggtctggctgttatctcgatcttcatcatctccaatacggtaaagctggccatgtttgcccgccgtgaggagatctccatccagaagatggtcggtgcgaccaactggtttatccgctggccgtttgtcatcgaaggcatggtgctcggtctggttgccggcggactggccttcctcgcggaatggggtctgtacaccgagctgtacaacgtggcaggtacggtttcgctgtcctcgttccatctgctctcgttcgatgtgctgcgctggtgggtgctcggcgtgtactgcggtgcaggcgcgttgttcggcatcggcggctcggtaacgagtatccgcaagtttatggatgtataacgactgcataaaggagcgaatgtttcaatatgatgaaaaagaaaaccgtgcgcctgatctcctgcattattgcgggcatcctggttgcagcgatggtgttctcgatgatcgcctccggtctggtttatgccggtgcggtgagcagtaaggaactgaaaagtaagctgtccgatctggaggatcagaaggcgtcggtcaaggcggagctggatagtctggcaggcaaggtggatgaggttgcaaagacccgtgccgccctgcagaaagagatcaagctcaccaaggaagaaattacgacggtaaccgcgtatatcgaccgcctgcaggaccagatcgacgtcaagacgaccgagctggatgctgcgatcaaggcgttggacagcaagaaggagcgtttttctgagactgtccgcacgacgtatgagcagggtgagaccagctatctggaggttctgctgaacgcgtccaacttctctgatcttctcagccgtctggagattgtttctgcgatcatggacgataataagaagatcgtagcggagtacaccgctgccaaggaggatattcagcagaagcgcgatgatctgcaggctacccaggacgagcaggtgcagtatcaggaaaacctgaagtacaaggctgcggagctgaaatccagcgaggagcagcagaaggcactgcagcagagtctgcaggcgtaccagaaggagcagaaggccgagtacgagcgcatcaccagcgagatggacaccgtaagtgaccagatcgcagagcagtcccgcaaggaagctgctgcggcagcagcagcggccgcggccgcaaagaagaagggcggcagctcgtcctcgtcgagcagcagttcggcgggcaatctgagcagcgcaacgctgacaagcggcacgttcacctggccgcttccgggttataccaataattcgagtgcctatggctggcgtgtacatccgatctacggtacccgcaagttccacaagggcgaggatattccggcaccgaccggcacaccgatcgtagcagctgcatccggcacggttaccaccgcaggctgggtttccggctacggcaactataccgttatcaatcacggcggcggcgtcatgacggcttacggccatcagtctgccatccatgtttcggttggccagagggtaaccgccggtcagaccatcggtctggtaggctccaccggcaactcgaccggtccgcatctgcactttgaggtatatgtaaacggttcgacgcagaacccgatgagctacttcaactgacgcaatcatataaaaggggagagtgtaacgctctcccttttctcgtggaggaggacaaaccatgaaaaaactgcgggagagacaggtctctctgcggatggcgctgaccatgtgtgccgcggcaggcgcgataacggcagtcatctgcctgatttccaccggctggaacaccaacgaggtcggaaaaaagctgcgcgagatcgaccggctggtgtcggacaaatacgttggtgagctggatgcggacaatgttgcggattacgctgcggcaggctacattaccggtctgggagacaagtggtcgtcgtatattccggcggaaaactacgaagcctaccgcatgagcggtgagggcaagggctgcggcatcggcgtttcggtgacgagcaccgagacgagtattcgcgttacgctcgtgtacgatgattcgcctgcggcgaaggccggcatcgaaaagggcgattacattctcggtacgggagatctgacgaccgaaaaggacggctcgagcgcggttatcagcgcgatttccggcaaagaggggaccgatgtgaccgtcacggtcaagaaggcggacggctccgctaagaagctgaccatgcagcgtgccgttgtcacgcagaagatggcatggggcaaaatgctgaatgataaaatcggctacatccgcatcgagaatttccatgacggctgtgccgatcagttcaagacggcgctgcagttgctgaccgacagcggcgcacagtcgcttgtcattgacgtgcgccacaacggcggcggccgtgtcaaggagatgagcgcggcactcgacccgctgctcggcgagggcaccattatgacgctgcgcatgaaaaacggctcggagaccgtttatacctcggatgcggactgcatcgacctgccgatcgcggtgctcattgacgaccagagtatttcggcggcggaattcttcgcggcagccctgcaggagtacgaccgcgcaacgctcgtcggcacgcacaccaccggcaagggacgcgctcagcgcacctaccagctgagcgacggttcggcggtcaatctgtctgttgaagaatactttacgcccaagggcaaaagccttgcagatgtcggcattgtgccggacattgaggtgaagctgaccgatgagcagacacagaactttttctttctgacgtcggaaaccgatccgcagcttcaaaaagcgatggaaactgtgggataatcgagcgctccggcagaaaatcggacataaaatggtcgaatcgcttgacatggcattggtgcttaatttataatataatgtactgtacggctcgaaagccgatgacactgagtaagaagggtttgcaaacatggcaaaagaaattaaactgacacaggaaagtctggacgcatataaggacgaactggaatatctgaaaactacccgtgcggatgaggttgcagagcagctgaaggaagcacgctccttcggcgacctgtccgagaacgccgagtacgatgaagccaagaacgagcagggcaagctgtattcccgcattgccgagcttgaggagatcatcaagcacgcagtcgttgtaaccggcgacagctacgctgcagacgaggtttctcccggctgccgctttattgttaaggatctcgaggaggacgaggaagaggagtaccacttcgtcggctctcaggaggccgatccgatggacggcaagatctctgacgagtctccgttcggcaaggctatgctgggcaagaaggtcggcgatgttgttgaggtcgaggcaccgatcggcatcgtaaagtacgagatcattaagatcgagaagtaattcgattcgtcctaacggacgttaaatgtaaatctatatgaaagatggggaagatatggcagaacagcatcaggcgcaggatcagcacgagcagaccgcagaggaactgcacgagctgaagcgcattcgccgcgaaaagctggcagagctgcaggctgcgggcaaggacccgttccagcaggtgcgctttgagcgcgatcactataccaccgatattcacgagcattttgacgagctggaaggcaagaccgtccgtctggcaggccgcatgatgtccaagcgcatcatgggcaaggcttccttctcggatatgcgcgaccgctacggccgtctgcagctttacatcaagcgcgacaacgtaggcgaggacgtatacaagggctacaagaagttcgatatcggcgatatcatcggtatcgagggcgaggtattccgtacccagaagggtgagatttcggtttccgtaaccgagctgacgctgctctccaaaaaccttgcaccgctgccggagaagtggcacggtctgaaggacaccgatatgcgttaccgtcagcgctatgttgacctgatcgtcaacccggaggtacgcgatacctttgagaagcgctcggctatcgtgcgcgagatccgcaactttatggattcccgcggttttatggaggttgagactccgtgtctgaacaccattccgggcggtgcggcggctcgtccgttcatcacccaccacaacgcgctggatattgatatgtatctgcgtattgcgaccgagctgcacctcaagcgcctgatcgtaggcggtctggagcgcgtatacgagatcggccgtattttccgcaacgagggcatggacactcgtcataacccggagttcaccaccatcgagctgtatcaggcatacaccgattaccacggcatgatggatattaccgaggacatggtaatccatgtctgcgaaaaggttctgggcagcaccaaggtgatgtatcagggcgtggagatcgatttctccaagggctggaagcgcatgacgatggctgaggctgtcaaggagtacgccggcatcgactttatggcgctgtcgccggaagaggcactggaggccgttaaggccaagggcctcgagatcgaaaagggcaaggagagctggggcgacctgatggcactgtgctacgacgagtacgtcgaggcaaacctcatgcagccgacctttatcaccgattatccggtcgagatctctccgctggccaagcgcaagccgtccgatccgcgtctgaccgagcgcttcgagtgctttatttacggccgcgagctgtgcaacgcattctccgagctgaacgacccgatcgaccagaaggagcgcttcgagcgccaggttgctctgcgcgccgcaggcgacgaggaagccggcatgatggacgaggatttcatcaatgcgctggaatacggtatgcctcccacgggcggcatgggcatgggcatcgaccgtctggtcatgttcctgaccgacgcggcatctatccgcgatgtgctgctgttcccgacaatgaagaccctggacccaaagaaggctgaaaacaaagccgaaaaagcagcggtaaatggttctgcagaggatgcaaccgtgtccgcgccaagcgtacagattgatctttccaaggtgaaaatcgagccgttgtttgcagatgatgtagactttgagacattcagcaagtctgatttcagagtggttaagatcgaagcctgtgaggcagtgccgaagtccaagaagctcctgaaattcacactgaatgacggaacagaccggaaacgcaccattttaagcggtattcacgagtattacgagccggaagagctggttggtaagacctgtgtggcaatcacaaacctgccgccgagaaagatgatgggtattgattccgagggtatgctgatttccgcagtgtacgagtatgacggacgggaaggcttaaatcttttgatgctggatgacagtattccggcaggagcaaagctgtactaaagaggtcatttactacaaaaaatcgcgttactacaacttttctacaacttttgcgcgagaccctacgaaaccggatgaagcaatatgaaaggcggatctgcttataaaatgcagattcgcctttctttttacatcagcttcatgttcacactaatgttttttgccttctcctgcatattctcttgtgtaatatgggtgtagatgtccattgtagtagagaaatcggcatgccccatgacttgctgaatgaatttaacatcgttggtgctttcgcagagccgggtacagaaggtgtgccgcaagttgtgaacactaaaatgagggagcagatccggttcacggtcttccagttcagcctgatccatttcctccatgttgtaagttacgctgattctctcaatcgcccgattgatattgtgggcgctcatgaatgagccggttcggttgcggaaaacaaaaccgtgaactcctcctaacaccagttgatcgtctggatacaatgcgtcgatggtttcaatctggaggcgaagctgctcggccacctctggatagaggatagggataattcgtgtaccgctctcagttttgggagtggtaatgtgaaatccggcttttccgtcaatgacccggtagattaagttgtggttgaccgagattgtgttttcgctcaagttaatatcgcttttggtaatgccggtacattctgctacacgcattcctgttccaaggagcacagtcatgatggggagccaatggctgtatgtaggggacttggcaataaaacgcaggaaattctgctgttgcgttttagtgagtgcgatccgccgtttaggctttggagcgctgccatccgtcttgagcttgcggtaaatgcccttgctgggatttttgcggatgtaatcgtcgtccacggccatttcaagcgtagggtgaacaatggtgttgatgctctccagtgagttgatagcaaagccgtgtttcagcagtttggtataaaacgcgagaatatcacttctgtggatttgtggcagaggcatgttagcgaaaggctcttctttcacatagaagtcccacaggtaaagataatttgctctggtagagggcttcagtttgatgttgttattcatgtagaccttgaacatatcattcagggtaagcttcatggcttcctgagtacggatgccatcatccttatctttgttgatctgcttttctttgacacgaagacttgcgagatcggagtcgtaaagatatttctttttagtgcctaatttgtagacatacatatagctgccatctgcccgttgtgtttctccaggccgaagatttcgtcctttgttgtcttttctcacttttgccattactggtacctcctgattataaaagtgtagtgcgccttactggcatggttatttagccggaaatatcataaagatattctttgatacgctggacactccataggacacgggtgttcatggtaatgcgtgcattggcaagatccccaatctgtactgcagtgtgccttccacagcacaacagtttgcaaagggtatcggtatcaacagccaagcactgctccggcggtaggtcattcggttttcttttctccataatcgtcctccttttttcgattacaatgatcccttacgatttgtagaagaaggttttcaacaaaaacaatgaaaacggtcttgaggtcaggaggtattgaaataacaaaagaactctaatggggccatttcctacgccagaacggttctgccgtgtatttcaggctgctgctgtgcaacacttcgattatgggcgcgcttctgtggtcatcgcacactgtccagaattcctgtataactccccatagaggttatgaacttgtcaaggtactaaaagagcgtagggatcatccggtattaccaaatgatccgatacatcctataaataggcggggaagaaagaacttctgcaaagaggaaagaaaatttaaagaaaatccaaaatcaatatatagaatgtttgaattgacaagcactatatattgtgttagaattgcaatgtaattgatttttgtgcgttgcccgtcagggtacacaggctttagggcttgtgttgcggagtaatgactgcattgcacacgctgttaattttgtacttgtgtcagtagtatcactgcgccttttcaggccggtatattgctggctttttttattttacgggatttacccaccattgcgagaatgacatcggttcataggcaactatggacgccaggctttatgccgtctgtcattctcgcttttttattgcctgtaagcctgaaagggctttaaggataaatcaaaactgagaaaggcaggtcatgtacatgaatgtgaagcagaaaagaaagcagaatggtcggcgggtcaagccggcacactccacggactggaagatgaagagacaggcagtatcttcgctccggccccaaaatgttgcaccaatggcgagggcagttattttgccccgaagatcacgaagggggatttgatatgtctggcagcaatagtgctgaacgaaagcggcatgaaccgctggtgctggtagaaacggcagatctttcagaagaagaatggctggattaccggcgccgtggaatcggcggcagcgatgtatcagcaatctttggcacttctccattccggacagccagggatctgtactacgacaaactgaacatagcgtcagtggaagatgatgagggcaactgggttgccatggaaatggggcatttgctggagcctctggtagcaaagatattcgagcggaaaaccggatatcgggtctaccaaatcaaaaagatgttccagcacccacagtatccttggatgctggctgatgtggactactttgtggaactgccggatggcaccacagcgatccttgagatcaagaccacaaactataatgccagagataactggtggatgaatgggaaggagactgttccagtctactatgaatctcaggggcgtcattatatggcagtaacggatcttgaccgatgtttcttttgctgcctgtatggtaacaacgaggaggaagttattatccgggaggtcaagcgtgatttcgagtatgaggctgagatggtctttttggagcagtatttctgggaaaaccatgtgcagcgccatgtgccgccgccctatacagaaagtggggccttgattattgagagcgcacgcaaacactttggcccggcagataaaaatgccccggccgttgcacttgacctggatatgactgcaaaacttatgcagtatttgcggcttctggatgaaaagaaaaatgcagaggtgtactccaaagaaatcgacaaggatattcagcgtctgaaggcgctgttgattgcggaaatgggtaccagctgcactgcagtctgtgagcaggagggagtgaactatacggttacctatacccctgttcgcaagtccgtcatcgacaaggataacctgcttcggttgaaactggagcatccggatatttacgagcagtttgttacagtatccgaatccagacggttcagtgttagagcctcgattatggaggccgcttagtgaggtgaaaaaggatgaattgtattggtacctacgacgggacgattttttataatcctgccaataagttttgtatcatcagtgtaaaaaccgcagaccagagtgtgccagctgaggccaggtcaaacaggcggtacaaagaccatttgattcgctttacagctgtggggtatgagattccacggacagatgcggtagagttggaactggatggtgaatgggcaaaaggcaagtatggtgtccagctccaggtggagcagtggcgtgaaattgtgcccagaacaaaaaacggcgtagagggctaccttgcctccgggcttatcaaagggattggtcccaaaactgccgcagacattgtggagcggttcggtgtggacacattggatattctggaacaccagccggagcggctgttggagatccggggcattacggaaaataaattggaggacatcaaagcttcttatgcagaaaaccgtatgctccaaggaattatgaccttgctggcaccgtttaagattactcccaagacggcattgaaaatatatcaatatttcggcccgaccagcgtagagattttggaaaagagcccattcgagctttgccagatctccggctttggatttcggcgggtagatgcaatcgtacaaaagagcgggggcgatctccatgaccccatgcgtatcaaaggggctgtcttttgtgcgctggatgagggcaagagtaaacgaggccatctgtacatcagttctgaagaactggagaaatcagcgctgaaactgctcaatgagaagatacctgtaccggagcttcgcctgcatcagcaggaagtcagggatatgatgcaggaaatgatcctgaatggagcaatcgtttccgtgaaggataatatttatcttcccagagtgtttgcccaagaggatgaaacggcgcgccggatcgcccagcgtctggtcacccagatgccagtagagcatattgcgccggtgctggaacaggtcaaggttgaaatgggactgcgcctgtctgcacagcaggaggctgcggtctatgcagcatttaggcatggcttgtcagtgattacgggttctcctggtactggtaaaacaacagtgctgcggacgatacttgaggtttaccggcggctgcaccctgatggcaaaattgctcttatggcgcctaccggtcgggcaagccgcaggatgtcggagagtaccggctttgaggatgcccgaacattacacagtggtctgggactgaccagtgaagaggatgagggtagccggaacagaaagtcagagccactgtcggccgatttaatcattgtggatgagttttccatggtggatatgtggcttgccgagaaattctttgagcgcatgaaggcaaatgccagaatcgtactggtaggcgacccagatcagcttcccagcgtaggagccggaaatgtgtttcgtgagatcatcgagacccaaatcgtcccggtaacggtgctggatcagattttccgtcagtcgaaggacagtctgattgcctataacgccaaatttattaacgagggcaataccaaactgttttatggaccggactttgttttcgtgtctggtgatagtcaggaagacaccgctgaaaagattacagaacggtattgtttggagatacaggagagtggcattgagaatgtgcagattctttcacctttccgttcagaaggcgccgcgtcgtcggaacagctgaatgaaaccattcgtgaattggtcaacccattccgctctgcggaggaagaaatcaagtttggccccaggatcttccgggtcaatgaccgcatcatgcagaccaagaacacagaaaaggtctctaatggagatctgggcttcatccggtatattaaggacactgaccagggtaaaaaaatcggcatggattttggcgctggcagaacactggaatacggcgtagatgatttgagcaatgtggatctggcgtatgccactacaatccacaaggctatgggctctgagtatgagaccgtcattatgccgctgctcaaagcgcacaccatcatgatgtaccgtaatctgctctacaccggaatcacgcgtgccaaaaagcgggtggtgctgattgggcagaaacaggtattgtttatggcaatccatcgtaatgagatcggcaagcgaaatacgctactgggtatgcgcatccagatgtatttcaaagcctacgcaaagaaagccggcatccccattccggctgcgttggaagagcaattaaagaacgcaagttaaaaaagagaggtcaggtgcagaaatggcacttggcgtctcctatttttatgtcagaaaggagtttccaacatgaatgaaaaaagtaatccgatgcctatgatgtacaaaacaattccggcagtggcagaactgaacaaggtacctggctttgatccgctcaaatttctgcgccataaggtgtccagaaagaccaatgaggaaatgctgcagttggagttgccctatcagaaactgtggttccgtctgcgccacccccagggccgcatgaaactgactaccctgaggatcacggaacagcttgcgattatggaggccagagtttatctggaccgcagtgatgcagagcctatcagcagttacatctcgcagcacagtgcggaagaaggtaccgattatgtgcaggctgcccaggatgaggcattgagtgctgcgctgtcggatgccggtttcggtttgcagtttgccgatgttgctgttgacagtacgggcaaggtgtttggaagtagtattccgctttccggggcggcttctatccagcagccaatgccggatgcggcacagaggcccgtagaagcctctggagcggcgttgcggcaatctggcggggaagttcatgcccgactggaaagagcgcctcagagcgtcgtagagcgccgtaatgcgcctgcgcgtccgacctctatccagaaacctgcggcaaagccggttcagaatgaacagcccccggtttctccggtacagcccactgtccagcagatggctgcagaagagaaggagaatatggatacgctgcctgtcggcaaggtagaggagaatgctcccaatatggagctgccggtacccaaccgtgaggttacattggatagcagtccaaaacaggatgatgtgtctgagcagccggccgcacccgtattccaatcggatgaaccggaagaactgcctgtggcgcctgttgttcagcaggaagcacctaatcagcccctggcgccttcttatacggagagcactccggtagaagatatcttgaaggtaatgacctttgaagaagcgcagaatgtggtggtggatagcggtctgagcaaaggaaaaaccatggcaacagttgccaaggagcgtccggtgagtctgaaattctatctcacccctggtaacaagagtaccaacaatatcgttcgtgctgcggcgcagatcatgctcgatggtatggccgcacagaaagccggatgataagcagccccatctatggggccaagaagggagggagaacagatggactcatatccaggagattttccgttcggtattatggatgtagtggaacttctacatctgcgaatcagacgccgacaggcaaacagtgtatatgtggattgcccgttttgtggtgaccgccgcggcaagatgaatgtgaatttcgtcaaaaatgtctggcggtgcaattattgtgatgagcatggcggtatgcttgcgctttatgcgcggctaaacaatacgactacatccgatgcgtattgggagataggagaagccctgtgcaacgattttcacagggaacggccgaactctggatatgagatggcaggaaaccagcaggctggtactgggtccccggtttcggggactcagaccgaccttgccggatatgagaggaggggcgaactaaaaacagtgcagcaagcagaacgggccagcggacaggaaatccatcaaacgctttcgctgctgctcgctatgctgcctcttcagcctgcccaccgcaaccatctgcactccccaaaacggggactgtcggatgaacagattgataggatcgggttcaagagcactccacccccattcctttgccgctccattaccgagcggctgatgaaacagggatgcaaggtggagggagtgcccggcttttatctggatgacagcgggcgctggaccatgaacttctaccgaaaaaacgcagggattttgattccggctgtgggatacgacggtatgatacacggcctgcagatccttttggatattccgctcaagcaaaaagatgatccgccggataaggcaggagccaaatacatctggttttcgtcctcgtccaaaaatatgggtgttacatccgggagtccggtacattttataggagatccatctgcccgggtggtctatgtcattgaaggattgctgaaagcagacatctcacactgcctgacaaaccggacttttgtggcgattgccggtgcaaacaacaccagccagttggatacgctgtttgcactgttggcacagaatggcactgaggagatcattgaggctcatgatatggataagtacagtaaccaaatgacctctaatggggcatctaagatctatctgatggcccgaaaaaatggaatggcatgtcgtcggctgacctggaatccgaattataaagggtttgatgattggcagcttgcccttcgggagaaagaacagaaggaaaaggaggtgcagagaatgaattttaagcagcaatatctgtgcggtaagtgtgattttacctatatagatggctgcgtcgagctttggcacaccagagcggagaaagatttggacctgacagagtatctggggctgacaaaggaagagtatcagatatttcttgctcaaggcaatcaggcgctgaaggatattctggacagccagagagttttccggagattttgcatttaccagctttgcctgggtgagacacagacggtacctttcgcgttcaagcaactggatgcactgcgtaaggctggatatgaacagccgcctgccgccgcctatcagacggtatggagcgcagaggtctgttgcccaaagggtcagaatgacatggaagtgctggggcgtctgttcctggactacaatgaacatttgccggaagattacagaggtcgtccgttggctccatctgatgtggtggaactggactgccaaggcaaacgcacatacttctatgtgaatgactgccgggattttgcaccggtacgcttctccccattcttgtgtaaaagacttccggagcctgctcaaaaacaggaatgaagggataggggtcagatgcgtattgcagaaaagaagaaaagtcagattgcagcactgtatgagcagtgttccggccttccggcagatgtcagaagttgtctggagaatggctactttaccgtaacggtacctccgccatggaatatgagcaatcaaaaggttgcgcaggaggtgcaggacaaaatcaaggaatggtcaaggcagtatactggcgtggtctgctactgttttgacagcttcagcacacttttatatgtgctgtgagcaacacacaatggcatggaaaggatcataacggcctgctccatgccttttttgcgaaaggagattttacaatgggtgttttttcagaaatagcaatggagcagcaaaacggtatgttcgattcgtctgcagcctttgaggatgatgaagcctttgagctggaggagatggaatctttgcctgtgccgcctgtaggtacagacactgtcccagtatcggcggcttcggtttgtgccggtgagactgctttggctgatgcagaggaggaacctacggatgaagtagcgcctgctggggaagagaagtctgctgaggaggggaattcggcacaaccgcccgccgcagaagatgaagaaaaaaagcgtgcggagcatgaggcggctgaagcccagcgcaaagcggaatttgacgccaaacagcaggcgaagaaagccgcagagcaggagcagatcgcccgtctggaagcgatgagtgatgaagaagtaatcgcggcctctacccagcgggtaagtactgatgtggaaaaactgacgcggcgcaatatgaaggagtgtgtgtccgagcatattcagatgctctgtatggaagatacggcgtttgcccgtctgacaatgcatccgaaaaagaacatgattcgctgtttccagtacatcaaccggaaagcctgggattatgtacaggatgaactaaaagcaagcggaacccgccctggtcccggacagcaggcgtatggctgcgatgtgccggatgatctgtgctatcagtgggcggaagattatttccgtgaccctgatgccaaggaagaccatgaggatgaggaaaagtttgttcccaagccgtatgctgggaagtcctctgcaaagaacaaacccaagaaggcggcagagaagaaaaagacggaacccaagtcggcacccaagcaggaggaaaaaaagccttctcaggatgggcagatgtcgctgctggattttggtatggcaaaggcaggctgaaccggcaaaggaggaaaaatgcagaatgattgcttataagggctttcgccccgggctgatatgccgtggctatcagtttgtgatggggctcaatacgactgaaaaagcaaattgcagggaaaatggatttcactgcgcggaggacccgcttgactgccttagttattattccagcctggagcattcggaatattatatcgtcaacgccggcggcgacatcgatgaagatgagcatgactccaaaatcgcctgtacggagctgactgtgattaagcggctaaccaaagaggagttgtttttacatggtttggcatacatggtagatcatccgcgcagggtgtggagctcccatgtggcagccaaccgggcaatggcgaactgcggttatgcggtggtacggggcaaagaccccgttgctaccggaagactgggagacatccttgcttttgcgaaggaagctccggattcggaaagtatcgtacaggttgcagtgggccggattgacggcgttacattactgcctgatgtgtggtatggcgtagatttgacaaagaggatggtgaattgagatgaaaaaaagagccctgatggcacttcccaatctgacagcgacggatgaaatgaagaaaatcgcgacttcagacctgccaagaaaggaaaaaactgactacggatatgttcgggaagtctgtgagtattatacctatctgagatgtatcaaacaggatggaatattgaaggtggctttctttttcccagagcatcttcgcttggatgggagtaatccggcctatgaagtgtatctggataaagaaaagcggcagtttattacctataacagcctgatacagaaatggtgcgaatccaagttggacagactggactggaagcggcaatactggtataccaaagcctactggatcagcgaggaagatgagacatctatacagacatatctgaacattgataaaaaagcggtagaggccatcctgcagtttcagcgggatgtgcgcgatgaacagctcgaacagcggcaccggcgggaaactgatccatgggataaagatatggaacaggtgccggaacttccgaaggactggagtcgatgggtggataaggttgccatccggcaaaattacatttactaccactacaaaaagggcggcgccaaaacaggttattgtacctactgcgaaaaggaagtaccgatcaaggtacatccacatcacaatcaaaaaggccgctgtagttgttgccgccattcggtggtattcaaagcctatggacgagcggggtatatgcagacagaaaaacattttgcctacctgatccagcgatgcaaagttggctttgtagttcgtgaatttcaggctgaccggacatacagaaaagaaagccttccaaactccagactttattgccaggaaatccggcgcacgatttatgacaaggaaaggaagccaagaacctactattgggggttgtataagcagcgcaatatgcgttggatttccggatccccctgttcttacaactggtctggttcgcataatggacgggtctatggcaaaacgctgccaactctggaacagaaggaacttcgatgcacagggctggtcaactggattcggaagcagaaaagcgttgatccggaaaaatatctggctgtgctcgaacggataccgcaaatggaacagatcagcaaggcgagcctgccgaagcttaccagagaatgtttcagttcctgcggaacggtcagtgaacttatcaaaaaccgtagtacagggagcctgatcaaagccttgggacttgacagcagaaggtttcagcgccttcggctccataatggaggctgtgatctgctgcggtggctgcaatatgaaaagggcaccggcagggaaatcccggataatgtccttttgtggatgtatcagcaggatattaagcccagggatgtccagttcattgccgaccgcatgagcatggtgcaggtctataactatgtgcggcgtcagatgccatctttccggcgaaacagccatgaggtactgcgtacatgggaggattatctttccatggcaaagaaactgcacatggatgtttatgatgagatcgtatatcgcaccagaaagctgcggcggcgccatgatgatctggtgctcaaatgccaggagaaggatattgaactgcaggccgaggagatggaggagaaattcccccatgttaatgccatctgtcaggaaatcaaaacgaaatatgagtacgccgatgcggattatatggtagtggtgccaagcggtattctggatattattaccgaggggcgtgcgctccatcactgtgtaggaagcagcgaccgctactgggatcggattgagcggcgagaaagctttgtgatgtttctgcgtaaaacggctgatcctttccatgcctattacacgctggaagtggagccagatggaacagtgcggcagaaacggacggaatatgaccggcagaagaaggacattgagcaggcaacagagttcctgcagaagtggcagcgggtggttaccgccaggctgacagaaagcgacaaggcgctggctgcagagagccgtgtccttcgtgagaaggagtttatccagttgaagaaggatcgggtcatcatccataccggccatttggcaggaaaacttttggtggatgtgctgatggcagatctgatggagaacacggatagcatccagtctccggcgctggctgctgcagcgtgacaaatgagaatggccgggcatcctttgggtgtccggctattgatgaacaaggaaggagcagagcatgaaacaaattggaaatctggcagtggtttgcgccaggcgacaggatgtgctgctgcaggttggcagtgaaaaggtatgtgtccatgtgggagccggaccagagcggaatacgcttcacgcagcgtgggacgatgatgacgccattcagcgtattgtccatgaattgaattttggcaggtatgcagccggcagaaatgggctgcataccgcacagcaggattgccctgtggggcggggaaaggagaaaagcgcatgatcaaaaacctgaatcagctgcgcaggacacttcgggaagggacgcagttggagatattggatcactgccggccggaatgtattggacagatacggaacattacgctggtaaacacgcagggcttttatagtaccgtagcgaatcagccagatgcgtctgccaacagagggaacggcggccgcggcccaatcctttggtggggcagagccgcccactggcagtttacagacggtgtttgcagtgttttcgacagtgaacagaagcatacggaagaagaactggttatgtccttccgggtacttgaaaaggaggcagcataatggaacggaatatttttgaaaagcagagagaattgaatgaccggctcaaccgttatcgggatgagtattataaccgcaatgcgcccagtgtgtcagatgaggtctatgacagactctttgacgagttgaaagagctggaacaggaaacgggaatccaaatggcaaattcgccaacccagacagtaggctatcctgcggtaagcagactggagaaaaccagacatgagatcccgctgttgtctttggataagactaagagcagtatggttcttctgaatttcatgggtgagcagcaggtgatgctgatgctcaaactggatggcctgactgtaaagctgacctatgagaatggagaacttctggaggcggctacccgtggcgatggtgacgaaggggagatcattacccataacacccgagccatcagcggtattccttcccacattacctacaaagagagactggttgtgacgggtgagggctttatcagacccagtgattttgaggaactgaagaccagcctgcaggacagcagcggtaagccctataaaaacggccgcaatctggctgctggttccatccgtctgatggatgccaagacatgccaggagcgtcggctggttttcatgccgtttggtgtgctggagggctttccgcacctgacccggaaatcagataagctgcgggaattgcgtgcgctggggttccagccctgcaagtatctggtcacaaagcagaaactgacattggaaaatgtggaagccggtatttatcagctgaggcaatatgccactgacaaagatatccccattgacggtatcgtggtttcgtttaacgacatcgcctatgcccagagctgcggccacaccggacatcactataaggacggtctggcctataaatttgaagatgacctgcatgagagcctgctgcagtacattgaatggacaccgggcagaactggagagattgctccggtagctgtgtttacaccggtggaaatcgatggctgcgaggtcagccgggccagtctgcacaacttgtcctttattgaggatctggaactgatggctggaaaccggattctggtaagcaagcgaaatatgatcatccctcatgtggaggaaaatttggacagaggcggtttctctatggcggatacgattccccatgtttgcccctgctgcggacagcctacccgcatccatgaatcaagcggaaagggcgaaaagagcgaggatcgcatcatcaagacgctgtactgcgataatcctgactgtgaaacacgccggctgaagaagttcgttcattttgtcagccagaaggcgatggacattgaagggctgtcggaggctacactggaaaaattcattggtcagggatttatccatagttatctggacatttaccgtctggaccgctaccgggctgaaatcgtccgcatggatgggtttggtgaaaagtcctggcagcgcctttgggacgctatccagcagagccggaataccacctttgaacggtatctgatttctatggacatccctatgatcggcaacactgccagcaaggtattgggtcgtgtgttccactatgatttggatgagtttcgggatgcggtctatggaggctatgattttcggcagcttccggatttcggggagacattgcataacaatatccacgactggttctgtgtagaagataatttctgtatttgggaggagttacagactatgatgaatattcaaaagcctgctgtggcagaacacagcgaagacagggtgcaggataatccctttgtaggaaagactatcgtagttaccggcaaggtggaaccctacacccgggacggaatcaatgacctgatcgaatcactgggcgcccatgccggcagctcggtgtccaagaagacggattatctggtctgcggcgaaaatgccggcagcaagttatccaaggccagggatttgggcgttacagtgctgtcgcctgcggagtttttcagtatggctggtgctgagtaagataatatagcataccatcggtgtgctgtcagttaatcaatggggagagagccgaaacagggctctctccccatatcttttatggaagatttcaagtaggagggattttaatgcatatcgacaggataccggtttaccgggtatatcagagggctattgatttggagctttaccattcctttgccgaattggtagtacagacttctcaggacgatacggcgagaaggacttaccgacaaacaagggcgatgcagatatggcaggtggaaacggatgtgtccggctattttgaaccataccatttgcgttaccctggcgaggtgttggagcggtttgaggaaaaactgggcgatgatgtccaggtgttccgcgctctggccctggcgctgggaaatacctgtgcgatccagtctgacaatatgtttgtgggaaatcagcggggagcattcctccagaaattgcggcggtctgccggagaagatgtgtacctgcagggcgctctgtatcttttggaaacggacgctgcccggcggcatgacttgctggatgagctggcggcaaaggtatatgtcagaacggaggaggctttgtttgtactgtcgttgtttgatgatagggaacatggctatgaggtaatacatacccaactcagtcatctattcacacaaaatcggacactttcactggtatatgattttggtgtgctggaatggttcatccggttctatgcagagcaggcaaagaaataccgcgggaaagccgacctggtgctgcgcacgctgatgaaactgccgtatatgaatatgaagcccgacagccgcgaattttcggttttgactaaagcagggtatcgctgcgatgaaatcattttggcaaattctctcgctgtatgggcggacaggctgccggaccggttgagttccaagagcatcactgccgagaaaattgcaacagcgtgtgggcggatgcttctgaatgctccaaaggatctttcggaagaattttatgagtatcttggctggctgtttcggttctataacagctttacggtcaagtacgaaggatttcagggactctgggaagcggttcaatatggtttgaaccccacagcaccgaaaacactgttatggatgaatcaaacgatacagaaggattttccgtaccgatttgatgtgtttgatcctcagtacgatgatctggcgaaggaactggagcgggataactatatggagttgtttaccctgcagatgctgcattccaggcagaggatccctttgaaacagtggctttccagatatcaggaactgaccggagctgactatggagaatatttcagaagttggcatacgaacggtaggcgggtatttgcctttctggtggaaaagaaggaaatcaatctatgggagtttttcaagcagcatcggcaagatggtgaagatgcgccacaactgaaactgctgcgggagtatgccctgagaatttcaagttggaggtgtttccggtttgtagagaggctactggctgagtacactttttcccaacttcaaacgatttttggcgagcggttttactttcacgaatgctttgtcaggagtgaggggtattacagcagaagggaatataaaacatacatcagccgtccattcctatctgcagagcagcatcggcagctctatgactgggtggagcgttcagttttccagactgagccggaaaaatatgaggacttcgttttaagtgccttaaaagcaccggagatccaacgcctttatgataaaaaagcgctggcagcggtgttgcggcagtttttgctccacagcgagtataacggctatgaaatcaaccggctgaaggaaacattctattccaaggaagagttggaagatgagcgcagagccgaagctgagagaaagaagcaggaaaaacgactggagcaggaaaaacggaccatacagaaacgggaaaagctgctacagctttataacggcagcgccgaatctctggttaaattcattgggggatattattaccaggacgagaagaaagaggtactggatatggcatttgataagttggtggaatggcccgccggttgtgtgcagacgatggaggccaaagacgcacacgccttttttgaactgtgtggcgaactggtaaagtctgaaccccggccaaggcatgagattttgaatatggtgctgacaatgatcggaggtgaagcagcatgagaaatacattggaacatctgactcttttgaccagaatgaaggaggatggtctacttccggagcttacaggaagctttacagaggatgccatagagcaggcatgtggacaggtggagacacttcaattacaggaacggctgcacatccgaaagacaaagcggatacaggaagaactggttcgggtgccggactttgcagcgctctatggtgcgttgtgcaggcaggagattggcgatgaagaaattgcttcagtcttagagtcggcagatgggtatggagagagactgacagcgtatccccaagagcaggtgctggcagtcatgaaattggaactgttgccttccctgcggtttgaatacctgaaatactattttccctttgtgatgtatgaagaagaggagcaggtcatattggataacctgcagacttttcccattgcggagtggaagggactttccatgctgacggagcaccagcgggatatgatgcggcagtcgtttcttggttcgtatctgttttgctggcatcaaaatgaacggaaagctctggaactgttggaacagaatcgtccgctccagagagtctgcatcttgctttatcggtatggtgtgcggctgtttctgtcagtagagcgcctgaaagatctccggtggatgaaaatgaccgatgtgggaaaattccgccggctgttggctgtatttgaatatgacgcagaggatttgtctgctttttttgacctctggctggacaaccatgccggacaatatgacctcaactggtttatctcccagccacatcctttgagcaaggaacggagggaagaaattttatgcaaccaactgagttatctgaatgctctgtatgccggcaggctccatctggattttaatgctgtccggcaattccagttttcaattctcatttatgcggtggagcatagaaaaaagcattttttggaattggtggatcagaacagtgaagtgttcctgtccttggggcgatactctctattgtttgagccgggcttttgtgagcactgtaacatcaattccctgacgctgaagaatttgaaagccagcgattctgtgaaccgcagcgacagcttttttacgcttctggaagaagggcagcagtacacctttgaggaaatgtatcagctttggcatcagaaagaggtttatgtccggttatacactatgctgacacctctttccatagatcagcgtttgctgacactgcggcagctgataaaacgggatctggtcagccagtatacaggagatgcagagttggagcagcttggaaaatgtctgttggaaaggccgtttagcgaatggtatcggggttcatttgggcatatctgtgggctgacccggagtactgccatgagactgctgcagcactacgagcggctacaggcatatataccagatttcacagcggagtcggacgcagtatttgccctcaataatatgatggctcttttggaaaggacggattggaaacaggtgcggaaagatattctgacaacagatgcagactggctggatataaaagaaaaactggcattttcggatgattttgtggagcagaaccgggagactgtcacggaatttttactgcagggcggcgcggctatggtatgcgctctctatggggaactggacgggcaggagctggctgttgaagcgctgcgacggatcgtacaggctgaattgatgggccagttctataaactcaaatattttgccggtgacctgcagcgtgagattcgctaccctgtcagcgagatgcaggagagcctctggaagaaaaatctttcgttggcgcgaggtgcatttttggcaggggaggaggatgatttttaccacacgctgcagcttggcgaacttcctcatagtacctgtctgtcttaccgtactggaagccagagggagtgcctgttagctgccttcgactctaataagaagattgtccttgtgaaaaaggatgaagcggtggtggctcgtgcctgtctccgcttgacaaagggtgcatttcaaaaaccgtctgccgtcgatttttcttttgctgatctgtcgcaggagaatacggaggccggaaaatctgccgccgatgagaaggctgtgctgtttctggagagcatctatactttcggactcaatgatattgaaaaagaggaagtaatgaaactggcagtttccctgacaacacagaaagcggcagagctgggcgttgtggctgtacttgcaagacggtatctgggctgctatgaacgggatgagtatgtgcttgcaccgttctatgtgtatatctcaaaatccaaaaacggatggcagtatctggactctttaggcggagcggcatatacctcagcaaaagaggagtatgtagagcatccattcctggtcatacagactgccatgcatcatgcagaggcaaatagcagaaatgaggtgtattatgaataataggacaatggcaacagtttatgtgaatcaagatagcatttccgtcaagacctgttccagaaaaggttgctcaccgcagcgctttattattttgaaaaaggaattgcagcggttggaggagaaaaagtatttgatcaccaaagatatccattcctatgcagaactgcggctgtgtgatgcagtaggcggtgccaaagtgctggagttttccttcacatggctgaaggatgctggcagagacagcgtttccggttataccgagcgaataagactgccttatgagccgttccgctcatatgcggcaggtgagaaagaaaacattgatggaacacggtggcggctgctatccattccagaacagagcagaccaaagctggagtttcacagccggaaaaatctcaaggccgtagtggagaatcctatcctgcggcacaaactggggaagtttctggatcagcattttaactggtacaactacgaacgcatcgtcctgacagatgattacctgccttacagcttcttttttgagggctacatggtacagggcacaaagacctgcggcggagtaatcctgcatggtgaagaggacatccaaacggcgaaatacgggatacatacttaataggttaataggaacggagccgcaggtcggagatgatctgcggctctttatgtaagcataatcacaatagtcagcttgtactattcgaaataaagaactataatctatcctatggaggtacaaaatggactatatgacactaaaagaggccgccgaaaagtggggcgtgacacctcgtagggtaaattattattgtgccggagggcgtatctccggcgctgtgaagatggctggtgtttggctgatccctaaaactgcggcgaagccgattgatggacggacaaaacaagggaaggagttgcgccatgaataaaattttgattatagatgatgacagagaactgtgtgctttgattaaacgcagcgtacaagcagaaaacatagaatctgatttttgtaataccggaaaagagggcttgcagaaattaaaagagcaggaatatcagcttgtggtgctggatgtgatgatgcccggtatggatggctttgaaacgctggaagaaatccgcaaagagaacagcctgccgattttgatgtttacatccaaaaatgacagcatctctaaagtgcggggcttacgggccggggcggacgattatttgacaaaaccgtttgacatggacgaactgattgcccgaattgtttctctcattcgccgctatacccgctttaatcagcaagccgaaaccatgcaaaaactggattttgacggattgcagattgatcttgaaaatcgttctgttacgacggataacggcacttttgaacttccgccaaaggaatttgatttgctcctgtactgtgcaaaacatcaagggaaaattttgaccaaacagcagatttatgaggaagtatggggcgaagaatatttctatgatgacagcaacatcatggcgatcatcagccggcttcgtaaaaaattagaagtcaatccttcaagcccaaaatatatccaaacggtcaaagggattggctaccgctttaataaggaggtgtagccggtatggaaatcatcgttttcttgtccattgtgattgctgttgtggctgtgctgacttccatcgttctcgttcggcgcgtgaaaaaacaaatcgcagaaatgaccgatgcactggctgatgtgaaaaacggaaatggtaaccggcgtattctgtctgcaacaaatgaactgacagcacctcttgcctatgaaatcaatgagatcgttgtatcctatgaaagcagactttcgattgtccggcagacagaagaaaccaaccgccagcttatgacgagcctttcccacgatgttcggacaccccttaccacgctgatcgggtatcttgacgctgcacacaaagggctggtcacaggaaaagacagagatgattatatcgaaaccgcccgccggaaagcccatgatctgaaagagtatattgatgtactctttgactggtttaagttaaattctaacgagtttgctttagaaatccagagcgttgaggccgcagagctgacaagaaatatcctgatcgactggataccgatttttgaggataaacaggtcgagtatgacattgatattccagaacagcctgtccgggtaagattggatatggacagctatatgaggatcatcaataatctcattcaaaatgtaatcgctcacagccatgcggacaaaattaaatttaccctatcgaagaaggacaacaacatggagctgctgctggcggataatggagtgggaattgagaaagacgatttgaaacacatttttgaacggctttataagtgtgataaaggacgctccgaaaaaggcagcggacttggtctttctattgtccatcagcttgtagaaaagatgggtgggagtataacagttgaaagtttgccgggaaaaggaactgaatttatgttgctttttcctttggagagttaagcgggttcccgtctttatggcgggagcctttgtcattttactggatttcaaattgcaaggttaatgcaaggttgcggcaaggttaatgcaaggttggcatgatagaataccttacagaacaggaggttttgaatatggatacaaattatatcattgaaacaaaaaatctgacgaagcaatacggctcacaaaagagtgtggctgacttaaatatccatgtcaagcgtgggagaatttatggtctgttgggtagaaacggagccggaaaaaccactaccatgaaaatgctgttgggtttaacgaagcctacttccggtgaggtcaaaatctggggaaagtctttgcaaggaaatgaaaagaagttgctgccccgcattggcagtttgattgagtcccctggtttttatcccaatctgaccggcacagagaacctgcgtatctttgctactctgcgaggcgtaccaaacaatcatgctatcaaagatgctctggatctggtaggactgccctacaaagataaaaagctcttttcacagtattctcttggtatgaagcagcggcttgccatcgcccttgccgttatgcacgatccggagcttttgattttggatgagccgatcaacggcctcgatcccatcggtattgcagaagtacgctcctttattcgggagctttgcgacgcaagaggaaaaactattttgatttccagtcacattctttcggagatttctttgctggctgacgatattggaattatcgaccacggcgcattgctggaagaagaaagccttgctgagctggagcaaaaaagcagtaagcatatccggtttacgctctctgatactgcacaggcggcaagaattttggaacgcaatttccatgaaaaccatttctccatacaggacgaccacaatctgcgcctgcacaaccttgatctgcctgtggggaaaattgtaactgcttttgtagaaaacggattggaggtatcagaagcacatacctgtgaagaaagtcttgaagattacttcaagcgtgtgacagggggcgaaggaattgcttaaactgattaaatgcgaattttggaaattaaagcggaaaagattattatacgcactgatgtcattatcgttattttttccgttgattttggcatatatggcaaaggcgggaacaggtgcagatacaacggaacattatcttcaaacccgatttgattatgtttatacaatgatgttgggatatggattggtttttttgcttccatgtctaattggtatcattgccgctattttgttttttatagaaagagattgcgatacttccaaaaaccttagaacaattcctgttacaaatacacaactcattatggcaaaaatttctatgctctttatttttagcgttgcgttttgtctgacaagcacattatctgttgcgttgttttgtaaactgtttcatgtaggaatggtttatggtatgacttataagatatttatgagccttatttttggagttcttatcgtagcagcttctttgccgattgtatttttaattatttgttttaacaaaagttttttgctttctatcctgcttgcgtttttttattctatttttaactggggcatactagggacagttggaacatctataagtgctgcaaaaattgctttcttaaattctttcccagttatatgtgttatgaactggacaagcggcttaatgatggatcatttgcaaaaagacaatcttttgccggaagcctatgcgattgtaccaaccacttgccatacaatttttattatggcaattacagttatactttctttgtggctgatcattcgcttctacaaaaaatggacgaggtaaaagatatgagaaatattataaaaaccgaatttttaaaattaaagcgatattccgtaataaaagccggaattattatggcaacactttctccgttactgtcactgttttattccacggccaacggtggacagacatggacgtttgactattttatgcaacaggttatgattagtaactgtaccttgttttttccaattatcattgcattgatagcaggttatattataacaagggaatatacagacgatacgatgaagaatatatcaacaattcctattccatataaacagttactttctggaaaactacttgtcctattgttgttgacaatctgctttagccttataggatgcgtgctagcattagtaatcaatgttattgctggatttccaggagtgcattttggcaatctgctcaatatgtttattcgtgttactggggcgaatataggaatctatatttcagtcttgctgattattttgctattttgttgttcggcaaacaattttttgggtggggttgcgctagcttttgtgtatggatatttcgggacttttgaaggaacactgttaaattattatccgattaaagcaagcatgattttagtagaccctacttgtggcgcggaatatggttatacttatcacattttccctgcctttatcataatggttttgacattcttgatttctgtaattattcttgcaaataaaaagaaagacgctaggatattgactgttgctaagaagaaaaaaatagttagaaaaaagggatggtagaatagtattcagacaaagacaatagaaaaaataagtcattgcaggttctatatgttaaagtggagggatatatgggaaaaatctttgtactgtcggtaacagaccatgaagaatacatacttagcagaattatggagattattgcggccgagccaggatttgaccatactgtgtcatcccatccgtgtaatattcttgtttttccgggattggaactccgcctgaaggagagaacggtacatcgaaatggtgagttgatttctatgacccatcgggaatttgcgacattggtatacttggcaaaccatccatcctgggtattttctgctgggcagatctatgaagaagtgtgggggggggggagatagcgaaaactgtggaacggctgttgccagcgtcattggtcagatccgcagaaaactgactccggatatgccgaaagcgggttatattcgtactgttctggggagcggatacaaatttgaagttccgcagggtatagcagaatagaggtttttttaattcaactgcaccatacccatgtaactacaaaaagattttatacatagtcagcaccgccgcaatcgtatcgtttgcggcggcgttttgttgtacaacataacattgaaactattgtatgtattcgcatttttgcccttgtgctgaaaagtaggctatcctataattaaaaagaaaaatatctgattaggacatttctgtaacatttggtgtttatcttattagtatagctgaaaaataaggaaggaagtgaaggtcttgaagaagattctaattgtagaggacgatcagcttttgaaccggaccttggcatataatctgacctctgatggatatgaggtcatttctgtttttaattttgacagcgcggtaagaaagctgcgcgaaaatgaatttgatgtggcactattggacattaacctgcccgatggcagcggactggatctgtgtgaagaaatccggaatcgcggtcagcatacctatatcatctttatcacagccaatgataaggagagcgatatgctcaagggatatgaagtcggcggtgcggattatgtgaccaaaccattttctgtgacggtgctttgcaaaaaagtagcggcggtttttgcaaatctggaactgcggacacctcggcatgatctgtttgatgatggctttttgaaaatcgacttctccgaacaaagtgcgtcccttgccggagaatccctggactttacaccgaaggaataccgcaccctgttcctgttcgtaaagaacccccggattattctgaccaagcggcagattttagagaagctgtgggacattgatggggactttgtggatgagcatacgctgacgacgatcatcagccgtatccgcaaaaaaatcgaaacagatgagcggaaatatattaagacagcttatggaatgggctatcagtggattggcggtgagcctcgatgaagctgcaaaatttatctgtcagggcatttttgagaaaaattgtggcggggactctgctcactgccgcattgctgctgttgatttttttcctgttgacgaaagatgtgcgtgttgtcatttgctgcattatttttacagttgcgttttatatttggggcatggtttttctgcactattttcaaaagaaactttctctgttcaccgatggtttgtgccagacattggatcacatgatggacagtacagaccggccccaggtagactatgaagcggaaacactgctgtctcggatcagccatcgtctggaacgactctataatgtgatgcagaaaaccagacacatggcagagggagaaaaggaagaactgcaatccctggtatcggatatttcccaccagaccaaaacccccatcgcaaatttgaagctaatcaacgatacgatgctgacaaggccattgacagaagaaaagcgcaaggagtttttgcaggccacaggcacacagctggataaactggattttctcattcagggaatggtgaaaacttcccgtctggaaacgggtgtcattacgctggagaaacaagatgctgtgatcggggatacgctggtgagcgccatcaatggtgttttggctccgatggaacaaaaagagatcagcctgtcggtggactgcccatctgatttgacaatatcccatgacagccgctggacttccgaagcattgtttaacattctggataatgcggtaaagtacacctctgccggtggcagcatccaggtgagggtacgggattgggaaatgtatttgaggatagatgtgacggatacaggcagaggcatcccggaacattctcagggcacgatcttcaaacgcttctatcgggatgaagcggtgcatgatatagatggggtcggaatcggcttataccttgcccgtgagatcattaccatgcagggcggctatattaccgtcgagtctaaagttggggaaggatcaactttttccgtgttcctgcccataaaataattctgaggcagtctgttttggcaggctgccttttttgaaaaatttttagaggacaatggattttaggacaattctgcaacatttgggatttatgctgacagcaacatcatgaaattggaggtggccttatggaaatcacaaagacattactcatcaatgcagcttgcttgctgatcccgccggtcgttgttgttctgctgctccggcacttctttccaagaaaaatcagatggtcggctggtgtggtggctctggtagatctggtgatcttctggacagatatttcttattatgagagcgtttggctgacgctgttttttgttgtaattcagttagcaatggttttgcttatatctatccggctttataaaaaagacacacgaaaatgaattgtcctaaaattgaagcaattcaccctaaaactgttgagcctttgggatatttctgcaacatttgggggttaggataacagcgaaaggagtgaatggctatgacgttaccatttgaaaatgatacccgtatcattgtaaagaagttggcaaaacgaaacttaaaagcagataaaagtcgaaacatcctcattatcattacgattgccttagctacctgcttgataatgacaacgaccttgtatttttttgcttctcagcgaaaatcattaaatgatgcggctgggcgttatcaagcaattatcaatgaagtcgataatgataccattacgaaattagtaaatgacgatagggttcaagtgggggtaagtcatttattgggtttagtatcttatggggactacaaattaaccgttcgttcaatagatgaaatactaatgaaattagcaaaatatcctgatttagagggaaaattgcccaaatctacaaatgaaattgctatcacaaaggcgtttcttgatagagctggattgtccaaatccataggcgatactatatcgttaaatctgggagatggagaaaaagattataccttatgtggtattttgcctgtcgaaaattcaaattattccgtattcgtgtcgcagtcctatattgaaaacaagatcagcgaaccggcatactccgcttatatccgtttgaatgaatctgatggttggtctaaggctgctatacaagctgaattatcaacattgtgcagagaattggaaatacagccggagcaaatgcagttttcaacatattatttttctctcattgaacagagaagcagtcaatatatcactgtaatagcatttatcagtcttattatcgctttggcgtgtacccttgttatttacagtctgttctatgtgtccatagccagaaaaacaaaagaatatggaaaactgcggacaataggggcaactggaaaacagatgaaaagaatcgtttttagagagggatttcatctttccagaattgctattccgattggaatattagccggtgcaatagcgggatatgtccttgtcccgcaaggctggaacactttaatggtatttgtaattgccgctgtcacagctctgtttgtgtatctatgcgttatgattgctgtaattaagccagccaaaattgctgctcatgttacgcctattgaagcagtccgttatatggcgggcaataatgatgtaatgtcaaacagtacaaaagtgttacatcgttctctatccgcgaaaaatttagcgttccttaattttgcgaggaacagaaagaaaaccgctttaacgatcctgtcgttaggggtatgtggaattttgctgatggcaagctctgcatattttaattccattgatcccttagcgatggcgcgtaggagttttccttacggagaaattcgccttgaattaggcgattacgggccgcaggcacataacagcgaacaatattcagaactccaaaaatcgaatctgcttacagaagattttagagaatccattttggacatagatggtgtggaagaaataaaagaataccaaggcaccgttttgaatgttcgtatgccaacgggagatattgaaccgattgtttcagacgcatatacgccaagctctcaaaaattgcttgaacaatatttgattgatggtacagcggatttgcaggaactacttaataataatggcattattattgaaaatggcccacagtggaaagaaacttttgggtgggatgccgcgattggggacgaacttctgattgaagttggcggacaaacattggaagtaaaagtaatgggaattgtggatgcgaatatcccgtatggcggatatgatacgctatttattcctttagaaatgctgtcaaagatcgttcctattgataacctcaattatcaatttattgtagatacagatgacagtaaatgggcagccgcaaaagatgaaatacaaaagataattccaccgacttccagcctctatgttagtaccttgaatgattgggtagaggcatacaacgaaaaactattgaactatcgtatgccagtctacatttttattatgtttattggggtttttggcattatcaatctgctaaacacactgataacaaacatcttgacacggaagcgagaattgggtgttttgcaagcagttggtttgagcagtaaacagctttcaaaaatgttattgatagagggcctgttctatacattaggggtgttgcttctttccatatcatgcggaactcttatcgggtatcttctctgcaccgtctttagtgcaatgagtatttttggaaaagtaagctatcattttccgacagttgaaatgttcagttattttatactgatgcttgctgtccaaatgcttttctcgtgtttcgcaattcggcagataaaaaaacaatctctggtagatcaaatacgggaattgtcataagaatttttgaaatgtccgagcattgtaacatttcgcggacattcatgatttacaattatgtcctcaccccaaataggaggcaaagaccatgaaaaaaacgatggtgatttcatttatagctgctgcgatgctattgataccatgtacagcttgtcatgtagcagagagccacaatgaagtactggcacaagaaaacaaagagaacactgttaacggaggatataccattacagatattactgaccccgttgaagttcaaagttacattgagcagcaaggcggtgaatatactgccgatattatggctgttcatcaggttacatttaccgattataccgcaaacgacattacagatccggcagaaatcaaagcctatctggaaagtcaggggcaagaatataacgagaatattaccgctattcatcagattactttcattgacggggaagcgacaccagagggttccctttgcgaagttgaaaaatgaattgtcctaaaattgaagcaattcaccatggatttttatagcgtttaggacaattctgcaacatttctcctttactctatatgcaacaaattaagaaaggcaggtaactgttatgaaaattttgcagacaacggatttgaaaaaatactacggcacagagccgaacattacccgcgccctggatggcgtgaacttctctgtggaggaaggcgaatttgtggcggtggtcggcacttccggttccggtaagtccaccctgcttcacatgatgggcggtctggacacacccacctccggcagcgtgatggtgcgggataaggagctggcgaagatgaacgatgagcagcttaccatcttccgccgccgcaatatcggctttatcttccagaactacaatctggtgccgatcctaaatgtccatgagaacatcgtcctgccggtggagctggatggggatacggtggatcagaaattcatggcggatgtggtgtccatgctgggactggaggataagctgaagaatatgccaaacaacctctccggtggccagcagcagcgtgtggctatcgcccgcgctctggtgtcaaagcccgctatcgtccttgccgatgaacccaccggaaacctggacagcaggaccagcgccgatgtgctggggcttttgcagagaacgagtcgtgaatttaaccagacgctggtaatgatcacacataatgatgccattgcccagcttgcagaccgtatcgtgcggattgaggatggcaaaatcgttggataaaggaggtggcagacatgacattgccttttgaaaatgatacagggccggttattaaaaaattggcgtcacgaagtattcagacagataagcggcgcaacctgtttgtgatcgtaacgattgctctggcagccgctttgatggcagcgattttttgtgcaggagcgggaagtgacagaaaactggaggcggacattcggggacagtatcaggcggttgtggtgaattgtgaccatgatacgattgaaagactgaaagactgcccggaagtggaacgctggggcctttcccagaattacggttctgcccgctatggtgacagcgttctgactgtggagtatgcggatgccaactggatggaattgggtaagaagccttcctttactgggacacttccgcaggctgccaatgaaattctggtagaacgggcatttcttgattattttgaaatccccgcagaagtcgggcagaccatagaagtgaatcttggaaacggaaagcagacctataccgtcagcggtatcatggatgtggagaatgactcccgtatgttccagctttatgtatctgaagcatttgtggaggagatggcgcagggagagccgctgtttgaatttcggcttcgttatactggtgctgatagtatggagctggagcagctcaaggcggatattgcagcattcctttctgccaacgatgtctcagaggatcagattttttacagttccaactatttcgatatgcagggctttaagtccggcgtgatgaaatattacattcccgtggcaatccttttgctgattgcctgtgccgtggtcatttacagtatctttttcatttccgtaaagggcaaaatgcgggaatatggacgcctgaaagtgattggcacaacaccaaaacagatccggcggatcgtgcggcgggagggattgctgttatctctttgcggtatcccgctggggcttttggttggaggggccatcgggtttgccattttcccggcacattggagctggatgggcaatctgccctatctggctgcgaccgcagcagcctgcgccctgacggtatttctgtccattcatgcgcctgtccgcatggcggcgagggtatccccaatcgaagcggtccgctccagtggttatgaaacggcaacagaccgcaaagatcagaaaaaccaccgcattacgccgttctctatggcacagatgaactttaggcggagcaggaaaaagacggtcatcactctgatatctttgggattgacgggtgtgtttctggtaacagccgctacggtacttaactccatcagtcccgaaaagatggcgatagaagctatgggagatcactgcaactatgaggtcagctggatggattcgggaggcgcggaaggattgcctgccatcgcacgggaaaatccactgacagaagaacttcgtcaggaacttcttgccatagatggtgtggaatctatcaccagccatgaagtaacatccgcaacggtgaaattcccccaggaaagtgttgcattaaagttccctgtatttgacagagagcagatggaacaatggctgccggaggaaaatctggaacagggcagcgcagattatgaggagcttgccgcaaacaacggtgtggtcgtgacagattcggaagatcatcttttaagtatgttttatggctatacgcctgctgtcggggatgtgctgacctttgaatccatggatggtaaggccatagaagtaacggtcatggggattgcgaaaccgtcagtaacatcaggcaccggcgcatggggcctgtttacccttacagaagaactggccgatcagctctacccggacattgagaacagagaggctgtttggaatgtccatacatcggaggactcggatgcgctcagggcgtctattttcagcctgctggaaaatccggtgctgacggtcttttccagagcagaccacgcggcctccctggaatcgcagctaaagatgatgacccgcggtgtttatctgctgctggcgttcctgtttgtgttctctatggtaaatctggtcaacaccctgatgaccaatctgctggcaaggcagcaggagcttgggattttgcagtctgtgggcatgagcggaaagcaggtttcccgtatgctgattgcagaatgcctgtggtacgcgggggttacggtatttttgtcggttggcattggcggaatcctgggctggatttttgactatgtgatcagcagttttaatatttttggggaactgtcctatcaattccctttgatggaaacggttgtttttgttctggcacttttggtcgtgaccggaatcttctctgtggttgcggtccgttactctaaacggctttcccttgtagagcggatcaagaccatggactaaccagaggcggcggcttccgatatgaagccgccgctttgttgacagcagaaatataagacttaaaggagatgatcaaaatgacagtaccatttgaaaatgatacaggaaatattgtcaggaaactggcaagaaaaagtttgaaaagtgagaagcgtcggaatctcatggtggtgatcgccgttgcgctggcatcctgtctgatttgtttttcgattgtgatggctttgtctacccggcagatagagaaaaatcatgtggaggatacctatgaggcggtctacacgaaaattaccgaggaagatgtgtcctccctgaaggggctggatgacttctcgagggtaggagagtattatatgctggctgtggaacctgcggagcagggatacaatgcctcctatatttattgtgatgaggaaacgatgtatattgcccgtgaccagatgaagctgctggaaggccgattgccccaaaaggaggatgaggtggtggtgagccgttatttcctttccaactatggtgcagacgccgggattggtgaaaaggttatgctaagcagcgagagctttcacggagaatatacggtgactggcattctggaaggctataaggaaaaagaggtaaatggcacatccatccttctttccaaagaagccctgaagggatggagcggctacgaccccgctgattatcgtgcctatgtgcattttaagaatgagcagcagatggatgaaacagaattgactgcccgtagccgggagattgccaaggaatatcagctggaaatgccggtcatgaacctcagctatatgaaattctataagcagccggtgaatgtcagtatgcttgcgctggttgccggaatcgcagtcctggtcatcatcggagggtatgttgtgatacaaagtatcttccgaatctcgatcaatgacaaaattcaaagctatggacagctgcggaccatcggcacaacgccaaagcagatccggagtattgtcaaaaaggaaggccgtttcttaggatgggctggtatcggaatcggtattttgctgggatgtgcagccgggtttgcgctgttttcccgtgggtttcatttgccgttttatgctgctgcggttgttttgactgcgttgcttggcaggtttatggtatccattgcgatccgcagaccggtaaagattgccgccggtatctctccgattgaagcggtccgctttaccggcagtcagagcggaaatgcccacacccataagaagaatatgcggttaaatcccctctccatgggaattgcaaatttcaggcgtgaccgtaaaaagaccatcagcatcgtggcttccctaagtctgggcggggtgatccttttggtgacagcctctattcttctggttcgttcgccggagcggatcgcaaggcagtttttcccggatggggattataaaatctatatgaactctgaaaaaacagaatatgaggtaatgtcggagggaaatcctttgaatgaagcgcttcggcaggaggtgctggctgtggacggcgtgacagatgtgatcgagaatcgtcaggcggttcatgtgcggtttgagaatgaggagagttcttccggcggaatgtgcgatctgttgagtgatagaaacagggatcagatggaagcggcgcttgtgtccggaactttacctcaagattcccatagtattgcactggatatggaatatgcagaagatatgattggtgtagatgtggggtcagttataaaacttaccataggggatcaagagattcctgtcactgtttccggtctgttcctaaacgacgggcttaaaaatggtcatggtcctctggcattggacagcacctgcatggttgcaaccaaagagctgtttcaggaagcaatgcccatgatcgattgctttgattattcttggagcattgtcagtgatccccaaaaggcagagcagattgaaaacagtctgagtgcgatcatttcttctaatcccgaccttgcactggacaccattgggatacataaggattatgaggaaatggaaaaccgggtcgtttttggagggcttcaggcactgtcctggctggtattcctctttggcgtggtcaatctcatcaacaccaccctctccaatcagatgtccagaaagagggaaaacagcgtctttcgcgccatcggtctgaccagaaaacagctttgtcaaatgaccatttatgaagggatctgctatgcgttttttgctgcattggcaaccctggcagcgggcctcccgattgcagtgattgctgcccggaaattcagtgaaatgactttccatggagtcatcatgccatattccttccccttcctgcaaatggggctgttcgttctggtgctgtttggcctggaggtgattctgtccttctggacaatgcgcaggcagaaaaatcaatcgcttgtggaagaaatgcgagcgatggaataagcatataggattggcggggcggcagtgcgctgccccgctttttctattatcattttatttctaattaaaatcaggaggatatatgaaaaagatactgttgattgacgatagtgatacctatatatggaatctgagaaagtatttacagcgccggggctatccagtgaaaacggcttccactttgaatgaagcgcgggctgccatccaagaggaaatgccgctggtggtctgctgtgatcttgacctgccggacggttccggcatggactttctggacgaggtgcggatcacagataagaagctgtcttttattctggtgtcctgccatgacaaagacgactacgaacaggaggccatgcgccggggcgcgacgctgtgcatggacaaaatgaaaggtccgctgctgcaagataagctggtggaatacgcctaccggcagttgtccggcgaaaaggccccgacttttcacaagctgctctttgtccatgcggaagataccagtgccggagtgctgcgggcggctatgctgcaaaagggctttgacctgattctggtttcctcgattggggaggccaagcgccggatttttgaggataaggaaattgaactgatcctgtgcgatctggaactgccggacggcacagcaatggagctgtttcatacgctgcggcgggtggcggggatgttccaaatgaagaatccccctgtccggcttctgccgttctttatcctcaccgagagcaacgaccttgccacggaatatgaataccggcatgagggcgtgaacgactatatcaccgcccccggtgaatatcccggagctgatccggcgggttctgttttttgtggaatgaaatcattatacatataaaaatatgtctttatgtctttgtagtggacaggatagacgcttttttatgagaaattggtcaggacagtaaatttattgtcccgaccaatttttgctattatgaacttttcttaaactatattgctttttgaaactctgtgtgttatactgttatacacaacagcataacagttaaaacacacggaggatgcagcaatgaaactgattatttcaaatgtatctggcgtccccatatacgagcagattaagcagcagatcaaggcggctattttatccggcgagcttcaagccgaagaaactttgccctcccttagaacacttgccaaagatttaaagatcagcgtcttaacagtgacaaaggcatacacagaattagagcaagagggttttgttaaaaatgtgcaggggcgcggatgtttcgtaatgggttctggttcagaactgattaaggagcagctcatttgcaaagtagaaaacaatctcaccgaagcaataaaagctgcaagaatggcaaatctatccacagaggaattacatcgccttttggacattttaacggaggtaaaaacagatgactaattatttagaggtaacgaacctttcaaaatcttttgattttttccagcttcacaatatcagccttactttgccaaagggatatattatgggcttgatcggcccgaatggttcaggcaaaaccacgacaatcaaactgattttgaatatgctcaagcgcaccggcggcacagtcaaagtgatggggctggataatatcgcagaagaacaaaaagtaaaatcagagcttggcgttgttttcgatacaaattatttcagtgatgattggaaagtgtcgcaggttgaaaaatccatttcggtattttatccaaattgggacagccagaaatttgcggatatgttacggaaatttcacattacaccaaccaaaaaggtaaaagaactttccaaaggtatgcagatgaagttaatgcttgcctgtgcgttttcatacgacgccaaactgctgatcctcgacgagccgaccagtggacttgatccggtttccagagacgaacttttgaaaattctttcagagtatattgaagatggcgagcatagcgttttgttctccacccatatcacaggcgatttggaacgtgcagccgattatattacctacatcagttatggcgaattgtactttactggcagcaaagatgattttgtagatatgttccgcattgtaaaaggtggaattgaggaactgtccgatgatctgaaaaataaggcggctggtattcgtacattccctacgggatttgaggctctgatgaaaaccgaagatattagcggtttccctaacctgaccgttgagcctgccaccattgatgaaattgtagtgtttacaagcaagaaaggtgacgattatgagtaatattttgaaatccacaaaattagatattgcattggtaaaaccatattttaagacgatttgctttaccctgcttctgccgattgtgtttgccgcaatcaatcgttctttgctgacaggggtatcatttgctatgtgctttattgccatgacgacgggatataccttttccattacagaaaaaaacagcatggatcgtctgtttggtattttacctgttcgtaaaagcgagcttgtgatcggacgctatgtttttgtccttgcaatgggacttctttccttgattatttctttgattgcacagccgcttgtcttgaaagtgctgggtgaaacagttggcgtatttgatattgtaactgccgctattgcaggagtattcttatttgcactctataccgtgttccagattccgggatattacaagtacggctcaatcaaaggacgagtatttatgtatattccagtggccggttttttggtgactttacttcttctctcgaaaatgccagctatcgggaactcaattatttcaagcgttgaatcttctccgatacttcctgttttgattgtgtttttttctattgtcgcgatgtatgcggtttctatcatcttgtccattcggattatgaagaagaaagaaatgtgaggtgattgtatggatttcacaattttggcagttgtgcttttgattggtgttggcgttcctatccgtaataaactcatacggaaatatcgggataagaagcaagatgaaaagaaaaatatgccagagtaatttataaatagcagcaccggagagtggagttagtatttcctttccggtgctgattttacatttaggacaattctgaaacattttttatactggaggtagcaagtcgttatatcataaagcttggagttctgttatgttttggatcgttattgacttctattacggttagtgatatatttattacagcaaccgtaataaggaggcaggtgttatgcgggacaatgcgaaaggtggtgcgctcacagaggtgacattctttattttgctctccctttataccccgaaacatggatatgctgtcatgcaatttattgaagatagtacaaaagggcggctcacgctgggggcaggtactttatatggtgcgttgaactcgttgcaggaaaaaggctggattgcgccttttggagatagtgcgggacgaaaaaaagaatatctcattacaacacaaggaaaagaaattgcagaaaaggaactgataaggctcaatgaacttgtaggagtggccaatggaattattggaggtgcagtatgagcaaaaagtgttatcgtttctttggcggtttgttgactgcccaggaacattggctgaataaaatgtctgaaaagggctatcgtctgattcgggcggaaaaaatgttgtatgaatttgaggcgtgtaaaccggatcaggtaaaatactgcgtggagtttatcgcgcaaaaatcgaaagccaacgcgtccgattatcatgagtttttagaggggatgggttacaaagtattttataaaaacatcaacttgaactactctgttggtaaagtacgcctacggccatgggctgaaaaaggcggacgcatagcaacaaatgccaccacctttaatcgggaactgttgatcgtagaaaaagataatgacggtaagccgtttgaacttcatacttcttatgaggacaaggaaaactattacagaaatctgcgtaatccgtggttgctgatactgctcatgtttgcaatatttgcggttgtaaatcgctcggtagtttttggtgtgcttgccctggtttctctgattcctgttctcgtatatcaaacccaggtgatgcagaacaaacgcgaaggtaagacaaaagaatggtgaggtatttatatcatgaatgaacgagaaaaaacgatccgattatggtttgatatgtggctcaatcagcaggatatgggcattgatgatatttttacagaagatgtgatctatacagaaagctggagtccccagtataacaaccgaaaaacagtaaagcattggtttcaggaatggaatacccgtggcaaggtagttatttgggaaatcaagcaattttttcataagggagatcaaacgattgtagagtggtatttcaaaaatgaaatgaacaatggaagtatagaggaatttgacggcatttctttggttgaatggacagaggacaataaaataaaggcattaaaagaatttgggtgtaatcgcaatacctataatccatacaaggaaggcgatacccctcaattcaaagcagaaaaagcgaattggttttgaattgagtgcttatggaggtaaaaacatgatgtatcggacagaattagtagaaggaattaccgtggaaaatgtaatagagaaaatcaatgcaaaaatagaagaaatggaaaaggaaagctatcgacttgttacgatgtctttttggggaaccgaaagagctgtactggttttcaaaaaagggttaaagggtagtttgctttaacatatatacttgacttattcgaatgtcaatgggagaatgagcaactgcatatcgtattttttttacggaggctgatatgaaagaaaaaatattgataatagaagatgatccgttgatacggaatgaattgaaaacgctgctgcaaagcaacggctataaaacggtggctccggaggatttttccgatgtgatcgatcagatcaaagctgagcagccacacttgattatactggacatcaagctaccggggaccagtggcttttctctctgcaccgagattcgcacattttccgaagtgccaatcatctttgtgacaagctgcaacacggatatggacgagctgaatagcattatgctgggcggagacgcttttatcacgaagccctataacacagcgatcctgcttgcgaaaatcgcttctctgctgaaaaaagcctatcccacacagcaacgggaacagatggtctatggagatgcggtgctgcgtctggaatccagcagtctggactatcatggacagagcgtagagcttaccaagaacgaattgaaaattctctattaccttttcaagaacggaggaaaaatctgttctcgtggagatatgattgagtatttgtgggacaatcagttatatgtggatgacaatgctttgagcgtcaatatcaaccgcatccgggaaaaactggcgggcattggtctgacggattttatcaagacaaagcaccgacaggggtacacgatatgaacagcagacgatattggaaaaacaggctgccatttctgctgacgaaccttgtttgtatggctgcactcactgtatttctgctggtgtgtggcaattcggtttccgcagtagtattgatcctgattgtatgggcattgattttgctggctggacttgtccttgcttactggaaacggaaacggcagatgaaaaaacttctggatatggcggagcagctttccgaaagatacctcatttccgaagtgatggagctgccggaacaggccgaggatcaggtttactatcagcttttgaaaatggccggaaaatccatgttggagcagattggagagatcgagcgggaacgcctggagtacaaggaatacattgaacaatggattcacgaaatcaaaacgcccattactgccatgaaactcctatgtgaaaatcatcggatggactggacaaaagaacttctgctggagctggaaaagaccaaccgctttaccgaacaggctctttattacgcccgcagcgaacatacagagaaagattattctgtacgggaaatggcgctgtcccaagtggtgcatggggcgattgcagataacaaatatctgctgctccaaagtggtatgcgcctggaagtggaggaaatgcaggacacagtttattcagatgaaaagtgggtgcgctttattctgaaccaactgattgccaatgcggtcaagtatcgtacggaacagccggttctccgtatttctactcataaacggcaggatcaggttgttcttgtggtgaaggacaatggaatcgggattgctgcatccgatctgccccgtatttttgaaaagggatttaccggtcagaatggtcgtatggtccagcagtccacaggcattggcctgtatctgtgcaaacggctctgtgaaaagctgggcattggtattacggcagagtcgtcggaacatggcacagccatttccctttcttttcacatcaactgtctgattcatgaagtgcagagctgagaaccgttctgcacttcttacatttttgttagaactttgtaagaaaacttgatacaaacgaagccgctcttattttacaatagagatcagaggtgataacaatgaaagaaattttgaaactggatcatatccaaaaatattacggaaatggcgggaatgttacaaaagccattcaggacatcagcttttccgttcaggagggggaatttgtagggatcatgggcgcatccggctccggcaagaccaccctgctcaactgtatttccaccattgataccgtcagtgcgggacatatctatctggatggaaccgatgtgacggaaatcaacgaaaaacagattgcccggtttcgccgggaaaatcttggatttgtgtttcaggattttaacctgctggacacgctgaccatttcggaaaacatagccctggcgctgaccatcaacaaggttcccgcaggcgagattgatgggcaggtgcgggaaatggccggaaagctgaatatcacggatattctggataagtacccctatcaggtgtccggcggccagaagcagcggtgcgcctgtgccagagccattattaaccagcctaagctgattttggcggatgaacctaccggcgcgttggatagtcactcgtcccagatgctgctttcgacgatccagagtatcaacgaagatctcggagccacgatcctgatggtgacacacgacgctttctcggcaagctacgccaatcgcattctctttttgagggatggcgcgatcttcacagaaatccgtaagggtggtgattcccgcaggactttctttgaaaaaatcctggatgtcctcaccatgatgggagggggcatgaatgatgtacgctaaactggcacttcgcaatgtccgccgaacagccagagattacttgatttatgtggttacactggttttgtcggttggaatgttttatggattcttttctctggtaagtccctattacaatgcgacacttcccgtacccatccatttagatgtactgaagaaaatgatgcggatcgcagtaccattggtgggactttttgtagtatttttgatgtcctatgttaattcctatatgcttcggcgtaaacagaaggaatttgcgattgagacgattattgggatggagcagaaaacagttgccttcttattctttttggaaacttctgttatgggagctgctgcgattttattaggtgtactgttgggaatgctgctttctcagattatcagtgtgattgttgttcaatctttcggtgagaattaccatttgcatttgtctctgtttccggacacttttcttggaactgttatcttttttggtgcgattgtacttttgctgggaattaagaacctgtttgctgtacgaaaactgaaaatcattcagatgttgcaaaatagtcagaaaggtgtagaaaatattcctttaacgaggcaggttgggaagtgggtggtggtctgtaccgcagtttcaactgtgatccttgggatgatggctgctctaagctgtttggttttacattatccggcagctcttttcagggtattgtttctgactttcctggctgctggctttttggtatcagctgtgtttttctttcttgccggcagaaagaaaagagatggaagtggtccgctaatggcactcacaatttttggagctgctgaagggattgctcttttggttctttccccgctttttgattcgttggtacgccaaagaatagcgatacaggcgtatttgacgatgccaccagtctttgcactattgcttcttgtattttccttgattgctttttttagcaatcttacttggtggctatcaaaaatgattcgtaagccttctgccagatactatcggaatctgttctggcttgggcaaatcaagagtagaatgggaaccagttccaagacgatgggggtcatctcctgcgtcctgacagcagctctggtcctcttttcctatcttcccgttctggcgcttcggattcaatcgtaccagctcgctctttctgtatacgatgtgcaggtagggacgatgtaccgggcagaagaatctttgttaccaacagggactctggactatgatgcgattaccgaatatctggaacaagggggatactttgtaactggaaaggcgcagggagagctttacttccttgagaatgaggatattggcagtgggcaaaagaagattccgtttcttgcagtttcgttatctgactacaacgaattgagggcgttgtccggcctggaaccggctgtgttgcccgatgatacatttggggtttcttggaaccgggaagcagtagaaacggagatgcaggaaattgaccgaaatatccgtcagatccaagtgaatggcattgttcttaataaggcccaagacgccgactttcaggattcgataggaattaacctgtttaccagcaggacaaaagcggtttatgttttgccggacgcagctatctcagaccttcggattgcgaccacattttattctgcaaataccgataagcctttaacttatgaatttgcaaaacaatttgaagaaaatatgggcacatatcagagagaacttggaaatttcccgccggagtctgcatttattcgtttaaataccttacagtccaatgagggtatttcaaatatgctgttattgtcactgattggcacctatgcggcgcttgtgttgttagtaagcagttttactatgttatcggttcaacagcttacagacgctattgaacaaaaacatcgttttgacatcattcgtaaattaggagtggagcgtaaagaatgccagaaaactgctcgtcggcaaatgtatttctggtttggacttccggttctgacggcgatagttggaagtattggagttttttcctatttgctttggagcaactacaatgagattatcgcctatgttttgccttcgcaaattggaataatcctgaccctatcctatatctcttttataatcgtctttggatgttattttgtgtcaacctattacctgtttcaaaggaacatagaaaaacattaaaggaagggaggtcgtaatgatgtactggaagttagcaattcaaaatatccgcagaagcctgcgggattatatcatttactttgtgacgcttaccttgactgcggcattgatgtactcatttttggcattgggcttttcatcagatgttcttgctatggcagaaaatatgtcgatgctgacgactggaattctgcttatgtcagctctggttgcttttatgtcctcatttgtgatcggttatgcgatccgctttatgctgggacgacggaaaaaagagtttgcaacctacgaactgattggcatggaagcaaagacagtacgaaatttgttccttgctgaaaacagtatcatcggcacaggagcctttctgcttggttctttggttggcacagggctttctggtttgctgaatcaagtggtaaaaaatatctttgaggtaccgcatacctatcaggtttccttttctctccaggcatgggcagtaacatttttgttttttgccttgatgtatagttttgggatgctccgagcagcaaagattatccggcatcagaaagtaatcgatcttctgtatgataaccgcaagaatgaagaataccatttcaaatcattccgccatagtcttttggtagtattgctttcaatagccgcaatggttgcaggcgtgattttgcttgggcggatgcttcagacacaaaccaatgaagcatttttgtaccttggcggagcctgcctgctcattctggtgggggtttacgagctgcatcgccagattccgcttttgctgcaccgatttgcaaaacaaaatctgcgccataagtacaaagaagaaaatctgttcttcctggggcagattgggcggcgcatccattctgctggccggacaatggctgtggtggcgattcttttaaccatatctctggcaaccatgtttgtggggcttaccatgggagcaggctacaaagccaacatgaaagcctattatccctatgatgcaggcgtggcgattgatgcacctttggaaaaatccaacatggattccatcgtttcctttacagaggagcattgtggagtcgaggattctgtgagttattatctgtatgcggttcctgaaaaaccgatcgaagccttgtccttgtccgactataaccatttgcgtgaaatcctggggctttctcctgtttccatgagcaacaacgaatttttggttcattgcgatacatggaactatatggacggaatccgacagggcttggcgcagcagccggagatcacattcaatggtcggaccttgtctgctgcggaaacgccgatcctgacggagccgatggagcagtatcaaatggccggaacgaagggatatgtacttgttctgccggatgaagcagcttcacaattcgtcggagaaaaaatccgtctggcgatgaaactggaagatggcggatacccggaattgaaaagcgacttgaagcaattcctgaacagtgggaaatggcagccggaattgcagtccggtcaacagcttccggaaaaagtaacgatgggtgttacagtaaaggcgtggggcgttgccaattcgctgacgggatttacagctatttcgttctgcggattgtatttaagcattattttcatcattctatcctgctcggttcttgcatttgagcagctttctgccatagacaaaaaccagaagaattatgcagtcattgaccgtttgggtgtaccgagccacaggcaggcttccctgatccgcagggaactgtccacagtctttttgatcccactgctattccctcttttgctgacggttttactgatcacaggggcacagttctttttcggagaggcaatcttgcagcagggacttgtacctctttatggtctggtgacgatcctgctattctgtgcaatctacctgacctattttggtgcaacaatgttcttattcaaacgggttattcttcgaccggaaatgagataaaaattgaattgctacaaaaatgaagcaattccgcctgttttcttgccgaaaaagaaagaggttaggagatttctgcaacatttggcctttatcatagagtaataaattagaaatgctgataccttacaccatgcaaaggagtggattactatggcaaacaaagaaaagcgctttgaaacaatctatacacagggaacttccttgagtattgttgtagacaccgaaacaggtgtaaactaccttgtccatgatacggggattacccctttgctggataaaaacggaacagtcgttattactgaaataaacaagtaaactttatattggttgcagggtatcagcattctaattatgaataagggagggacatatgggaaaaatctttgtattgtcggtaacagaccatgaagaatatatacttagcagaattatggagattattgcagccgagccgggatttgaccatattgtgtcatctcacccttgtaatactcttgtttttccgggattggagcttcgcctgaaggagagaactgtacaccgaaacggcgagttgatttctatgacccatcgggaatttgcgacattggtatacttagcaaaccacccatcctgggtattttctgccgggcagatctatgaagaagtgtggggtgaggatggtgaaaactgcggaacagccgttgccagcgtcattggtcagatccgcagaaaactgactccggatatgccgaaagcgggttatatccgtactgttttggggagcggatacaaatttgaagttccgcagggtatggcagaatagaacaatcaaatatatattagctgcgatattatgaagcagtccaaagcgggaaacccttatgatgggtctcctgctttttgttttcataaaaatagtgtgtgattgttgagaataggcgtcatataggcgtaaaggatatgtataaagtaaaaaggaggcattacatatgcttattggcgttgatcatggcaacaaacaaattaaaacggttcattgcaacccctttgtgtccggtctgaagcagagtgtcacccgtccctttggacagaatgtactgaggtatcagaatacctactatacgctgtctactgagcggattccttatcggaaagataaaacggaggatgatcgcttctttatcctgaccctatttgctttggctggtgagattgaagcgaggggggcatattcctcagaggtgcagcgtatccaactggcggtagggttgccgccggcacactttggcgcccaggtggagcggtttacacaatactttgggcagcggggaatggtagaatttgaggtgcagggcaagccgtactccatctatattgaagatgtggcctgctttccccaggcttacgcagcagcggccaccatgcttcacacgcttgtggaggagcccaaagcggtaatcttggatattggcgggtttactgccgactatctgctgatgaaaaacggagagattgaccttacctcctgcgattcgttagaaaatggtgtgatcctgttgtacaataaggtgcgttccaaggtgaattcggagctggacctgctgttggatgaaggagatgtggacgctatcctgatggggaaaaagaccaaatatccggatgcagccatacggctgacagaacagatggcgcaggaatttatcagtgacctgttcagcacactgcgagagcgtatgatagacttgcaatattgcaaggtagtatttgtaggcggtggcgccattcttttgaagcggcagattgaaacttcgggcaaggtgggaacaccattctttgtaccgaaaatcaatgcaaatgcggatggatatgagtatctgtaccggattgaaacagcaggcaggtgatggtatgggcgaaaaaaaagaacggggacggtttacactgcgctttaatgagggagatcctatacacgagactgccattggattactggagctgcagagtccccgcacaaaagcacagtatgtggcaaatgcagtggtttactataatgagcactttgggcaggagccgcagccgctaaatgcttcggtcatcagcaaagaagcggtggtggctatcgtcaaagagattttgcggcaggaagggatgggacgggaaaaggtagaagagcagattcatccagtcagaacagagaagaagccagtagcgcctatggttgtttcggatgcacaggaggcgggggatgagactgaaatggacgatagaacacgcagtctgattgccagcgctttatctgcattccgcagcagaggataatcaaaagaggcatgggagccagtgatgctcctatgcctcttcctgtatggccgcgataaagctgtctaaaatatcttcaaaatgcctgtattgcttgggcgttagtgtggaaatcttcgccatgagaagggaggaatctgtttctgtgatgatgcctcgcaacaagtactcggtgctgatgttgagtgcatcacagactttgaggattgtttcaggccgcatagccttttgtcccagttctgcggtggagatggtctgtggtgtgacatgagccagctctgccagagtttcctgggtcatattcagttgtttcctccggtcgaagatccgtttacccatatcttttagtagattatccatgcgtcacctccatgccatagttacattttatccgctatgacatggattattaagcggttatggttgatttatctcgtctatggcaagtataatagacgaagatggatgccgggaaaggagaaccatatgaacagtttttcgtgtgtgattacaggccataggccgactcgtttcaagttcaaatataacgaaaaggacaagcgctgccagcggatcaaaaagtgtctgcaggagcagcttatacggctttataatcagggagtacgatgcttttgggctgggggagcaatgggagctgatatgtgggcgtcagagatcctgttgcacatgaaagaacagacggcgtatcaagatgtggaattgtgtctggctctcccctttgagggatatgatgcagattgggatgactggcacagaaagagaatgaagtttattcgtaaatatgcagcgaaggttttaatcctgggtgaaatgccatcaagtgagaattataaaaaacgcaattactttatggtggatcaggtcggctgtatggtggctgtttatgataatgtaaacaatatgcgatccggaactcagcagactgttaactatgccaaaaagaaaggactccaaatcatttatatccatccggatacggcacaggtaacgacagaagatgcaactttatggaaataataaaggaatagctccaaagcggaaaaatgcagtgaccgttttagagcttgttttgtcatataatgtcgaatgattttctctttcctcgaaggatattccaatgctactccaaaagtttccgaaaactgtcagttacactgtaattatggcagtgatcccaaaaatcaatgaaaattcggtaagcggaggtgggggtatgagatcagtacgatacccaatgaaaatcggaagtacagggcggtctttatcctgatgatggggataaaggccgcctcctgttttcatatagaatagctctggaacagtatttgaaaaaagtattattttacaatttaacaattatcagcagggcggcagcgttgcgctgccatatcgcgaaagaaaggggatgatgcaggccgcctgtgtgccgtccgcataactgcggacagggagtaacgatgttatggagaaaggattccacgacatcgagcagttcattgctttcataactccaggacacacggcttttcatgaacggctctcaataggggtgcatcgtcgaggcaggacaagggagttctctccacataaggaaaaacctccgcctgctcggacggtatctattgaactgctcgatgcagcaattcaaggaacagctggttttgtccattggtacaaagctggctgtttttctctatcacagccaggttttgtccggtgcaggtcaccgccagaagctcaggaaatccatcggaattcttgagacttttggaggtaaagccatgtggcaacggaacaatgggcaggcagaagatgacctgcaattcaggtttacagcatatttagtttcggcggtcaagcgccgcagaaaagattatttgatccagttttataagcgcagcagtatagagagtactgtggaagtggtctatgagtctgaacccagctcagaggaagtggtcttggacagattaccgcttatggatgtcattgagaatggagcgcttctggaggcgttgcagaaactcaatgaacgggaacgccagatatttctggctcgaacgctggaggaagaagatttcgagactctgggagcaaagtttgggctgtcctacaaaggggtggctgcactttactacaggacgatccagaaaatcagaaagagcattgaaggaggtgacaagagatgaattttgagtgtctgctcctcagtgccaaggacggaaacgaggatgccattacggcgatcttacagatgtatcgaccattgctgctcaagtatgctattattgacggcgtgctggatgaggatctgtaccaggaattgagcattattttgttgaaggcgatcaaattgtttaagatttaagtcaatgagaaaggctccgagatcattacggcctcggagcctttcttactgacttaaaagggagaactgctaaatttatatccactgcccagtatagtgcggatatagccaccctttggcgtatccggcgtcaatttacgccggatctgaccgatgacactggcaacggcagtgccgcagttttcaccgtctttgcaccatatagcttcatagatttgataggcagaaaatacccagccaggatggcgagccagatatgcaagaactgcaaattcatggtaagtcagagtaacaagttgaccgttgcaggatacagtttgctcctttagccgaatttcaaggtttggaaaggagaggctggtgttagagggtgggagagcaatatggtcaagctctggttcgtttgcaatagtttctataattttattgagtatgtgttcttcgtggtctgcaacggataatattaaaaatttgcccatattgttcacatcctttcttctccttatgcgcataagcagtggttctgtttttggcaaatcttaaatgagatgggggatagtgccagagacttttctatttgtaaaaggttgctgaatatagagacttcaaaactctgggactggggctatttgttctaatgcttaaatatcaccttacccagaattaaacttataaccatagccaattacagtttttatatactcgcgccccttgcaatatggttttagccttttgcgtatttggaaaattgtattttctactgcgtgcaaatggttatttgtaggctcatgccaaatcttttcataaatctgctcttttgtgaatgtggtttgaggagattgttgcagcagataaagaacttcaaattcgtttgttgataaataaacttccttctgttctaatattacacaatgccggttaacatcaatgtgtaaggtgtgacttgcttgcttcaatccccaaaattttagtgccattgtccggtcgtttgcaatttgtgcaagcagcaaggataattcgttaaattttctaacttctctcaatttcttatataggttgacagttatcgtactcccgtatatgtccttatcaaaatcaaaaatatgtgtttcgattgaaacagaatcatcattatcaagtgtagggcgtgccccaatatgagtaacaccataatatctcttgtcacttaaaagaatatctgccacatatacccctgtctttggcaaaaatgtattttttgctatttccatgtttgcggtaggtgtccccacatgctttccaataccccggccgtgtataacgattcccgttagtgtgtaaataggcgcattcgtattttctttcatttcgatcctcatataattccattcattgataggatgatcaaaacacaagtcacaatgatgaaatttgccagtataagtagaccagtatgttgctgccttgtgtctttttccaaagtagaaatatatccactttttcttaaagcggtaactatgggcttatacagtaaaaaggtaatggatgcatttaacccgcctttcaacaagttaaatggaagaaaggcagggagtaacaattccacaaccgcttctcttggataccccatataaagtggtgttaccaaatagttccacagcagcataacaataaccgttattagccaccccgatgccaggccaatcagtgcaccagatagagtgtgttttttttgtaaatgatagacgccgtacacgcaaaagatagtgtttgtacgatattcatgatacaacctaatattccggtatcgcttactgtaatcatttcaagggttgccacaatgacagatacgatacaggaagtcatcggtccccaaataaagccgcccaaagttacaataacatctgatgggtcatactttaagaatagaataatcggaatcctgccaacaaccatggtgacataagtgattgcacatagcatcccaatagcggtgattctttttgttttactgttcataattgctttcctccgtgacaaaaaattaacacccaaaagaaaaggtctttcaggtgttaacattataattaggccacagaaaagaaagtaagcctctcaaaatctgcggaaatctaaccatatcttctttcatccagactatactgttggttttggaattacaccaaatcgtgcgttttacgctcgcggactttaccgccaatcgggaatttcaccctgccccgaagacacttttattcagttgtttcctcgcaattataacatcaaccacttttggaagcaatgagttgaagaaagttcggaagcatttcggaaatcatcttatactcagttacagtttttcatacgaaactaagtcggtgagtggaatcctcagatggtcatgtctttctgtatctgcagcttcttcatttccataaccgattactaaaatattgattggctctaaattatcgggcaaatcaaattctttccggataacatcaggctgaaagtaacatacccatacggtacctaaacctaattctgttgcctccaacatcatatggtctgttaggatagctgcgtcaatgtctccggtttgcttttggtcaaatgggcgaacccatgctttgttatgatctgcacatacaataattgcaagaggagcattataaatatttgcccctttgctgattttttccagtccctctttgctttctactgcaattaagtgaaccggctgtaagtttgctgctgttggtgcaacatgagcagcctgcagaattttatcaagcttctctttttctacctttttgctgctgtaattgcgtacagaataccgtttttttgcaatctcaataaaattcatcatggtcaatcctttcttggtgctgtataatttagttgacatattcaatcgtcgtactaattttaacatggtgcagtagaataacaagattgcacttttcaggtagatacttccctcaaagaaagtacccaaaaaggagtgaatttataaaaatgaattatcaaaaagatcaatttagttgtccagtggaagccacactttttctgattggaggaaaatataaacctctcattctttggcatttgatagaaaaacctttgcactacatggaattacaacgcttaattccaaaagccacacctaaaatgctttcacaacaacttcgcgatttagaagaatgtggcatgattcacagagaagtaattccagaaaaaccacctaaaaccttgtattcacttaccgcctttggaaaaagtatcattccggtattagattctatgtgtaactggggaatacactttcttgaaggattggatattacaccgccttgtggttcaaaactgtaaatagtctatttggggaagagtagactgccgtttgtcgaatttatatatgtttttttcaagtaacacaggaagcaatacttgcagccttattttatataaaaagaagcgccggacagagccaataagcctatgtccggcatttcctatatcacggattcaaatttatatccactgcccagtacagtgcggatatagccaccctttggtgtatccggcgtcaacttgcgccggatctgactgatgatactggcaacggcagtgccgcagcgttcaccgtctctatcccatacggcctcataaatctggctggctgagaatacccagccaggatgacgagccagatatgtaaggacagcaaactcatggtgagtcagagtaacaagttgaccgctgcaggacactgtctgctccttcagccggatttccagatttgtaaaagaaagaatgttgcaagggagaggaggcgcaatatggttaagctccggctcgtttgcgatagtttccataattttattgagtatatgttcttcgtggtcagtgacggataatattaaaattttgcccatattgttcgcctcctttgcttggggtaaatgcggaaaactgctgcgccagtggccgccaacagtaccagaatcagcacagcaaatagacaaaagctcctttatccacctgctttcactgataaggtcattctaaaacctaaatgtccacgaaatattagaaagttcgggcatttcaaaaaatagtattctactcaaccgtttcaatcgaatccacaatactcatttttgaaattttccgtagtggaattgctgttgccagcaagcaagctcctactgccaagagggttgcttcaagaatgggcatgacagggattgcaacaagctggatagtgtcgctcgtggccgcctcaatgaagatcgtacaaacatatcccagtacgcttccgatcacagaggcaatgactccgtaatatgcaccttcccaaagaaaagttttataaaggctaccggagctcattccaatggcccgctgcataccgatttctgttactctggtgtgaatatttgtgtaaacggtattgatgatattaagaataccgatcaggccaacgaaaaggatcagcccccatgccagcatttgaatctgtgcaaagctctctttcagttgctggtcgctttcttcatacgacaagaatgttgtccccggcgtcctatcacaaaatgcctcgataaatgtatcaaaaatttccctgtctgcgccctcgttcagcgtaggcaaaaactctgaataggtatcttttcccgtcaggcgttcatagatagcatcatcaacgatcacctgaacaccatttgtgaaaccgccatttccaataccaagataaccgtcatagccatccaaggttttcaaaacattcagctccattcccgcaacacagatgttttctccggcctctatatttgtaaattcaagaacatcttcgccgtagctcatgggaataggattccttactatacaggcgttccctgatttcagttgtccaagctgttcttctggtaattgatcccccataaaataatcccaatattcatcgttcaatccgacaacctgaaaagtttcaccgggtttcagttgaaattcaagactgatttcatcgagcagcccattttcattttgttcgtaaagcgaaaattgtatggcggctacactttgcacagcttcatttttccgcaaagtgttcagatcatctgtggtaaatccaacactttcatttgtgatctgataatctcctaaatggttatcttgcagtgcgcttgcagcgttcaggagagaggaaaacccttgcagcgctataaaaaccgtgatactcataacaagggacaaaattgtaattgcagtacggcctttatttctctttaagttcagacgggcatagtatgcttcaaaattatggattttctttgttttacgctttctgcggcgaattttcagatttgttccagacatcgccataatgggggatacccttgcggctgatctggctgctggcaatgctgcaaacagcgcaaacgccaaagtgattgctccgcttaaaaccagtaaggttccattcaaagaactgttctctgctattagagttttcaattcagaagcatcctgaaccaagaacaattcaggggaaaccaagccggtagctgcctctaaaattcctctggcactcaagaagccaagaagcataccaataggaatcccaatcaggcacaataggattacttcaattacaatgatctgataaagctgtcctttttcgcctccaatagcccgaagtgttccatatccctttatccgttttgatacagatattttcagaatgttgtaaatcacaagaccagcagccagcaaaatcaaagtacccactaatatccctgcgactgtcataaaagagaatcccttatcattagcaccctcggaatttgcagtataggaaattcccaaggcgttcaaatatacaatattgtagctggtatcaagctcatggatgttcaattccttattgatgtcatcgacaactgcttgaaaattctttttatcggcagtccgaatatccacattgtaataaatataagattccggtaaaagttgttcggcagttccttcccctacaactcccataacagtgccgcttgtatatcctaagtagttatttttcaatatccctgtaagaacaaattccgctgtataggaatagcagtccgcaatgttgtggcgaagatttttttgcagtgaaagtgtaatcttatctccaatactgccctcaaagccaagatatttcagaatatcttccgaaagcgctatttccatcggggcttccggcagacgacctccttctacactggtactggacggatagatagcggcattgtcatccaaatattccatcaaaccaagggtaagagatggggagagttctaaacttcccatataaatagatttccctacataggaaagacgctcatcctgttccagtgcgtgaagctgatctgcattcatctgcaaaaaagtggcatatcggtttcctccgatagcgatggcctgctgttcccgcattgcactaagtacgccaatggattgtcctacaatggttgtcatcatagtagacagcacaacggcaatcaaaataagaatagaagtgactttttgggacagtagttctttcaatgctaatgtacgataagatttcatttcgctgtcacctccgtaagcacaccatctacaatctgaaactgccggtctgccattcgtgcaatacggctgtcatgggtaatgacaacgagagctttccccatctttttccatacattttgaagcagttccatgacttcgccgccgcttttgctgtccagatttcccgtaggctcatcagcaaaaattacatccggctttgcaatcaaagcgcgggcgatagctacacgctgctgctggccgccggataactcatggggcagatgttccaagcggccctgaatgccaagcagttctgtaagctgtttcaggtatgcttcatccggtttttgtttatccagcaaaagaggcatgataatattttctttcgccgtcagaaccggaagcagattaaattgctgaaaaataaatccaatccgtttccggcgaaatgccgacaactccttatcgctgtaactgtaaatatctttaccatcgtaggtcagcgagccggaagatggcttatccaagccggaaagcaaatgaagcaaggtgctttttccgcttccagatggtcccataatagaaataaaatcgctggatacaatttcgagattcgcatgatccaaagccactactcggttttcaccgtcaccataaatctttgataaattctttgcctcaatattcataaaaaaacactctccttatttgtggtataaggagagtgtaaatgataaatctcaaaaatcgctcaaggattacacaaaatgaaaaatagcagttgcggatgcaccgcccccaaccctattttccaaaatcaatcggccaccatgtttttcacataaaattctgctgctgtaaagccccattccgaaatgtgaggaattactacttgtcgtttcaaaggggtttggcccattctgcatgagagacagcggataaccagcaccatcatcttctatattcaatgtcatagaatcattttgcagcgttatttgaatagagattgctttttctgcaaatcgcgccgcatttccaatcagattttccgctacggtaagaaatagcccgtgatctatacaaactgttccgcctgatggtactaaaacagaaacttttttggatagcgctaacagtcgtgctgtttcctgcaattcactctgcaaaactgatagtctgatttcttttggcttaacagagaggtgttccaacttttgaacactgctcatagcttctacatactgctcgatccgtaaagtgtaactttccagccggtctatggtctgttcgtcctgaataccttgccgcaaaagttttacacttccttttaataccgtaatcgggttacgcagatcatgggaaaatgcggcattgagccgtttgcgttcctcggcctgttgccacaacagccgattcgatttcagaagttcactccgcatttcttcaaaggcagcacatagttgtcccatttcatcgttagacaaaatcggcagcgaaaaatccagatcattattctgaatccgcataatgccattttgcaggcaggaaataggctgtttcaatttgagataataaaaaagaaagactgaaacaatcaatccgcctactggaaaaagaatacaggaaaccgtctgcacaatgtttagggtagctaaaatacgctgttgtgacaccgtaggagacggcagaggtacaacagagccatccgacaagatttctacaccgcctaaaggataatggttttcaatgcctcggcaaaggaagataactgccccaagcaggagaaatgccgctgccaaacaggagagggataatagcaggaaagatttctttagtcccatattttttaggcgttccaccgataaccacacccccaaaccgtttcaatgtaattgtgcaatgtatgtgctgcaaatttagcgcgtattttccgaatgtgctccataattgtatcgctgtttccgtccccatccaagccccacacaagctcataaattcgctcgcggtcaaaaacctgtcctgcattgagggataaaagttctacaatctcaaactccctcttagatagcgggatgttcagattattgattgtaactgttcgggcggaataatccagtatcaattcaccaaagaagcgcactgccgaattattttggcgtcgctgctcccggcgcagatgtgcggcaatacgcgcccccaattcatccaaatcaaagggcttgacgatataatcatccgccccggcctgaaatccaatgatcttatcgctggattcaatacgagcagtcaaaaaaagaatgggacaggcaatgtgttcccgtatctgctggcatacagtcagaccatccattcccggcatattgatgtccaataaaattaaatctggtttgcaggctacttttttgagcgcttcttgtccgctataagcagtcagaatatcatattgtgtttgaaaataactctgtatcatatcaacaataccgcgttcatcatcaacgatcagtaatttaggattcaaaatcatgcacctccgttctttatatgatatatgataaatctcaaaaaatcctcaacttcctttgtttttgcggatattataacaggcaaatgtctgcgaaatattacaacggacagattttgaaaaatatatttcttcataattatatagcgggttgacttttgcaacaagcttttataagtacatagcaaaataaataactatttcatagagaaaaacgcactggatacagagctgataggcatactgtatccagtgcgttgcaaacttttaacctttcagatagtaatgcacataggcattataatctcgatgccgggtgactagccgcagccagatataaaagtgggcagtttccgaatacagattgaattcggtgggctcgctggtgggctgggcgtaccctcgacagaaccgtgtcagcgtgtccaaattccgaaactccggcagttggaacagcgcattctgaaaagcatcaatttcacgggcaacttccagaacaggcgtatccttttggcactgatgccaggtggtccaccatttccatccatcataatcagaacgggaataggctatctcgctggcaggacgggagccttgctgaaacagatattcaaaggtgcaggaagtagtcagcagcggatcttcaaaatcggtccgctgctggctcaaaccgtttttgacagctgcccattctgttagggggagtgggcaacggttggcatcacgcagggcttcatccataccgcacgcctcgcagatatggacatctgcatagcggctcagggcgttgatgaccagcctgcggtccagcggctgaccacaccgaagacacaagggtggttgcgctgcctctggggtaaacagcagtttgtcctgctgccatacggtttccaacagggattggggatagatacggatcttcatgatgatgtcctcctattttactacctttaatattcgtaccgattcctccggtcttcagaccagggagggtagacacgcaattcctcctgaaacatggtcatcagttcggcagccatgtcctctttacgccggtagatgcgctgctttttcgtaccatcggcatagcggatggtagtctggagtgcgggtcctttctgtgtgaagatgaatttgcggccatgagaagggtcagacgcctcgatccagaggggcagggtggtggaaaccccatctggacaccgccagccgctgtaatcagtgtagctgaacccattgatttctcgtgccagccggcgcagggcaagatatagccgctcaaagcggcgccccagctcgcctttctgatgccggatgtagagggtgtgcccctcatggtccagggcgtccaattctttgccataaaacaggtattcagggtaaagacggccattcgattcaagaatttgtccggtaggttccgcaaggtgattgtttgatagccagaccggaaaaagtccgtctgcggcttttatattgatgaaagcgcagtggtcggggcggaatccggttaagttggtggtaagggtttcccaaaaaatcaggatgccgtgatccttttcataaagtttgatggcgagattgccgttgggatatgtactgattttcaaagtcagctgggctcggtgttcgcccagcgtaaatgcgagagtattcataagcgttttcctccaaagaagcaccagacgcctgcaaaaatgcagattgccggtgcttcttagtgtgtgttccgaacaaggaaaccggagcagggagaggaatgcagttcctctctggtcatcgtcagctacacagccaaagtctttgactcgaactgatagcgcagaacctgagccagctttgtcctgttttcacaagtaatgcgataggtagggccatagttacgcccctgttcatccatccttcgaatggaaatgttaaatcgggtgccctcctgggtgatccacagacgcctgcccgtggcagcatcttcagcaataatccataaagggcactgcatggtcatgtaggtttgggggtaagcacgccagccgctgcggtcatggtaacagaaaccgggggtagtctgcctcctttcattcagtacatcataaactgccttatatttcatgcgctgcaccgcctttcaaagtttttcaggtagcctgcatacccttccgggtccagctcctgcagccggttggcacgaaaacgatattcaggataggtgcagaacccactctgcatggtgcgaccggttgggatagccagaccatgtcgtatgagccaggtgggaaattccgaatcggcattggtgtcgataaaggcatggtctttttgccgttggccgggcaggttgacggtgagagtcgcccagggttccgggtcaccgctttcccatgtcaccatttgtatggcaaggtttccattcaggtaggaagtcacctgcagctggatggggtgcgtggcaccaaatttcttgtaaggcaaggtaacaggtgcagcatcggtatcaggctctccgtcctctacgcccagttcccaactaagggacaaaatctggctctggctcagcgtgcgggtatatttctttgcgtattttggcttgaagagcagggcaccgtcctgcaggagcagctttccttctttttggtcctgaatacagcgcaggccatgcagacggggctttgcgcgctccaccgcatcgtggatctttggatggtcaaaccatatggaatactgtacggctacatcgagattaggatgctcctgaaagcgtgagcataggagatccagcacctgttgacagacttttcttcgtttctccagcatctgacgttcgttaaaggtcagcgtgaaatatgagaaatcccgttcggatgcgtttgcggcgccgttaaagggattacaccagaagtacagatcccatcggtcgctgccataggacacagggatattttcgtcatactggtagcagacaaagtcctgtgcgatggcttccatgacgggtttcattgctgcgctgctctccaaacttgcctgacggatatactgctcccattcttcgcgggtgtggctgtcataaaactgtttgtttgctgctgcctctgcttcggtgcatagagactgcaggcgtagggagtggacgtcttctttggcatagcctttttcaaaccatctggtatcaatattcatatgagaacgatcttcgtgaattttcattttgcatcctccttgtgtatagttgctgcattttttgacgcagtgtggtcattggtctttccagtcatagagccgaccattctttcagactggcgatatactgcctccatgcctgcttggattcttcagcacgcttcaactcggcaagctgttcttccggcgacagggcttcaaactcgcattggcggcagtctctatcaatatcctgaaagatgcggttcaggatggagagagccagctctgtaacagtggggctgtgttcatcaagtgccttgcggccttgacggaacaattccagatagcgttcatattgctgttcgctgataaattcccagccgtaggcttcctggatgtcgctttcgctatggtattgcatagctgcttcaaattctgcctcgcggtctgcggcttccttttcgatgtgccgcttgagcttggcgcggatgcgctccaagtctttgagcaaaagcttgcaggctttggcctccatgagataaccgtgtgcttcgctgtttagatattgctgggatgtatttttcatgcggcagcttcctccttggatttggattgaacaaagagcaggaaccctttgctggtatcctccagaagctgccatgtaccatcccgccagacgcaggcggttgcatcattgtagacttccggcgtcttgggcgggtcgtcaaagcattccggcgtcacataaaggcacatatgtcccatatagaagggctgcagagctgcttctatctctttgcgcaaggcaagggcgagggattcgatctcgtcaatatcctgacgctgaaaggcagcatctgaaatctgtttgagccgcttggtttgcttcacagctgtatcgatatagggtacagcctcatcaaagtatttgtgtttgatccgcataccgtcaaataccagaaagcgggtataggcggtagcggctttacagatgtcttgccgcagggcatcaaatggttttttgtacttggttttcagcacctccatggatacgacctgcagattgcgccgcagggtttccagatggttcactaaagtggtgcgtagttcatctcgttccataggcatcctccgtgggtagcttccgggcggctatccgcgccggaagtggcggcagtgcttatgcacattggcgtggataaacgcaaagctcttgcaggccagcaatcggttccgttctctggaagattgccgggcaacgcttgcatgatactttttaacagatgtttttatagggttattcgagttcaggttcccaaggggtatcttcctcataaggcgcagcctcctttttattgtcagcggacttgttggcagcctgtactgtcagcagaagggcatcttccccgacatcgctgctgtgggactttttggctcgtttctttttgcatctttccacggctttgtcatagtcgtagccgataccagcttgcagcttatccgcaattttacgaagcttttcggcatggtactcataggtagcacgatggaatccagtcagctcccactgatcgcacaccgattccaaaagccggacatagtcccgcagtgcgttgactgttttgtagatatcgccatagcaggtagtaaaggtatggacgccatcaagattccgaaagcaaaaaatcagttcttcccccaaaaactgttccagttggactgattgtgcgatcattggccgaaaagattcctggggcagttcgggcagtctgttctcatccattgctatcctcctcatgttccggtattggcggctgtgggcctaagcctgccgcaaacatctgcacagcggtacggtaaccagaggcgtatgcctgctccaatacagcagaattgcggcattgtaccgcagtctgatactgttcaaaagcgatggacgcctcgctggagagcagcggaagcagagctttttctttctgttgtactgtctggttaaaaggtgtgaagcgtttatcgggcttgaacacatctgcttcatattcgccgtaatagagcgaagtgagaaagcgtgggtctgccggaaaggatatagcagatggtgcagggcgggaaagcgccgccgcaatgtctttgagtgtgttaatcagtgcggggagctgaacattaaaaaatctttgccccattgctgtttcgtgtaaattcataaaataaggccccctttctaaaagccatttgccttttactgttccccggcaatccggtgcaggtctgctaacaggtgtcggttattctgctcatactgaggctgaaaaggctggtctaaatcaaaattgtaatagcggtagtagagtaccttgaatacaatgccttgccgcatggcaggggcaatggcgcgcatcagtttgcccagttcggtggcaatctcatattcccgctttacatattctttgtcttccctcttaaaattctgatacaaccagtccttgacggatacccggctgccggtaaagtggctccggtgccggtccagacacaggcagtattcaaaatcacggccacgctcccctggacctacggtaagaggatagatacggcaggtacgggtacgggcagggtagacggaacagcgcccatccataaggaagatacaggagccgtttggggcttttgtcttgagcatatagatagggaagccttcttcggtcagaggttccggatcgcagtagcggaacaggaaatcctctattccttcgatgagctcaccttttgttcggagatagcgagccagacggtaggcatccagactttccaccattacacagccttcaatattgcggcagcatgccccgcattgacggcaggaaaagggaaactggtctttggggcggactggttggatctcattcatgatttcttcattcattttgttcctccataaaaagagccgtgacggaatggtatccgccacggccagaacttgtggaatagtcagcgggagccggctgttccaaaccatttacagtcccttcacgcacatgcggccaatctcacagggagcggactgacagccgccagcggaaaaggggacatggacagatggtagtgggagttctgcgtttcaaaacggacgcaatcctccgactcctccagaatcgtcaccacacgcgaagtatggtagatgtttcctccggcgtgcagaagcgcaccacgcccaacagacagcggacgcagcagagagccattcaaaacgatctgtttcttttctttcttcattcggtttgacctccaatctttttgaaaatgtggatgtaagggtatttcttatctgtaatgggttcatccatagcaaatgtccagcagtacatcgtggacttcagccagcaactctttaatgcgccgcatgggaaccttctgggtgcgggcaatctcacggagaccatagccgccctgtttcagatgaacaatatccatttgctgcttggagactctgccggccagctcgtggagcagaagatccatttccaactgctgcatgattgggtcatgggcaggaatggtatcttctaaaggtgcaccatcgggatataatccgacgtgaatactgagaacctccatattgcgcttgcggcgctcctgggtgcggaagtaatcatagagccggaatttcatttgtcgtgtggcgattgtgctaaaagagaatttttgtgcagatggagagttgaagtaatcttttactgcctttaaatatgcgaaaacaaccacatcataaaattcatcttccggcagatggttttcattcaggaacttgtagaccagtccgtgatgatcagtggcaaatgcctgttgttctttggttaatggtacttcacataacattgtgttttcctccttaaataaaaaaagagggatacctccggtgtgttaaaccgaaggcatccctttgttcatgtgtcatgtggcgcaggccacatcagaatacttatgcgggcagctgctcgcagtcaccattgatctggctgacagtatagtgaccgtctgccggctcgttggtcatggcgccaggctcgattacataatcgcagccggtgtcgcgctgctcctcagtgatctcggcacgctgctggagcaggagtttgatctgctccttaaaactgttggcgtaagcccggatctgagccagctcctcgccctggaaatcctgcagcagtttgaaggtagcaacactgtagtcattggtgccgttgttctcacgcttgagaccaatctgcacgatactgccgcaagtggcgcggcggcggagcatgaaggcccggttcagaaattccttgaagggcttgatgctggtaggaggcagatttacctgcagaggcatgtactcaccactgcgaagcaggtagagcacacgcatatttttacaggcttttcctttgctgccatcaggtgcagaaccaaagcggttcatcacgcaggcagcacaggcgcctccgggagtgccgatgccaaccttgccatccacagaagaacaaagcggcgtggtatcgtcgtcatattcgctgccagccggccagtaggcgcaggtggcgtggttatgtagaatgacgcctaccagattcttttcatagtcgggattgtccggatcatcggacggcatctcaaattggagtgtgccgccggcgggaatcttgacacgctgaaagctcatctgcagaccatcggcgtcctcagccagttcctcggcgctgaaatcgccttcgatcatagtggggagcatgaatttttcctgtttcatcaaatcgctgttctgattatacatagtggttcctccttaaaaattgtgatggttgcagatggtcaggcggccatctgattgatacggttccactgctgtcggggcatggacaggatattgtatccgatcccctccagggcagtggcgcggtcatagctgtccacatcctgactaaagcgtgttacggcattggatagcccatagagggtcagatctttgccttcaatcagacgctgcagaacgccggtgctttcttcctcggtgatattgaaatccttgcttgccagacggacaacgccgggaatatcagtggtattcatctgaacggttgtggcttcacgcatcatgccaactacccgtgtaaaccgcgtttcatccacggcggccatcatggtatctttgatcttcatggcaaatgcgtggtcatcagcggccaacgtctcctgtgagaacagttggaagttttcatctgcctcattgacccggccgatgtgagtgcggcgagtctgggcatcgttgacgaccatgccgttactgcataccagccgatagaccaaaggctggatgttgacggaacccagtccaacttcactattgctgatgataacgccggactgtacgatgtcaccgggtacaacttcggcttcaagccgcttgttgactaccttgatgtacatacggctgtccgtgatctggcagctttcaaaataggcgtcctccatttgctgaatgacaggaaggacgatttctgcaatgtccagattgtcaatgcggcgatagcggttgctcaaaaacgcccgtacagtgccatccagggtgcggaccatacgctgggtcggttcccgctggaaccaggaattcacattctctgccagcagttccggataatcggaaagcatacggtcatagtaagcagccggaatcttcagatgtgtgccgatctgccgatgggcaatctggttgatctccaatggctccaccagtgggtcatcgtggtcatcaaaggtgtggagataaagttgagaaccaaaaggttctacttgaagtcgcctggtatcaagcaaatagtcttgcttgagtttggattggcgttcaatctgctgtgccatttccacgatggtaagtcctgatttcattcgtcaagttcactcctttctctgtgttccttggcatcagaagcattaccaggatacctgaataccctgggcagtgacttcagccgccagaccattgctttccagtacctctgccagacggggccagtagaccttctggggaaagttgttcagatgctcctgagaaacagcatcttcgccctgctcaatgcagatatcaccgtcttcccgaagcgtcagtttgctgtgtccacgggaattaaggtcggagatcagtgcttccagtacagagcgtccctgcgtttcataccagatacggggatcaacaggctgcctgttcggaggtgttgcatcatcctcgtttgtttctccgccgaccttggatagcggaacgatcttgaccatatcgcatttgatattggcgttctgatccagtgtcacatcagcgtgatcaaactcgtcaatgccaaacacacggatgcggccggtaccgccattgcggatcagctgctccggctgcttttcacaccactcgaaggtggcttgcggataagcggagcgcagatatgccagaatacgatggttggtgtggcgaaccagcagttcatcggagctggtgctgcccaggtcagggatctcaaaacttcttgtttggatgccttctgcatggagccgtctggtgcgctgctgacgctggcgatgccgtttagcctgctgcatataggggagaagcaagatcaaaactacccacagtccccagagagtgaaaacgcccagaagtagccaaacctgccagggcccacgtaccagagccataattgcgatgaccgcaccaatcaggatcgtgatgctgccgctcaaaaatcctttgtcattattcatgtttgataccatccttttttctgaatttgttggaaaacaaaaaaagagggaccgcaccaagctttcagtttcattctgaaaaacttgatacggtccctcttgggcgccgaagtaaactactccggcagggattcacggtcgccgtccaatacctctgtgagaggtggtgcgggttccgcagtaatgtccgggtcattctcctgtctgttcgctgcggcgggctgtttggggaggaaaccaaagtcatttagactgaccttcagcttcttttccaatttaccgtccttcatgcgaacatctaccagccgctgtgagccggcaagccagatcatactgccttttttgaccttgaattgcatgagccgggtgacatctgcatcccaggcccatacctgatagaactgcgtccagtttttggtgcgttccatcagatcaaagcatacatagctttgtttggactggctttctttgggtacaaggtcgttcatgacgcgcccgaacacaaaaatctgtgccataacactcctttctgccattggcattattatctatataaaaaagtgccagcagtttttcggcccttaaagggcgcaaaaaatcactgacacttgcatacaaacttaacagcgtgtgcaatgcaggcttttggcctacggtacagatcaaaaagatctgtattcccaaatgggatacgcacaaaaatcaattacaagttcagtatagcactgtatcttgtgcctgtcaagatgtaaaacgctatatatagatttatagccagcgacaagtacgatatgtagtagttgaaaaggtcttactctgtaagatggttcataatacggtagtagtcgtccaataggtagaactgcgtttttgttggagatgcagtttggtagtcaaagatcagaccatataggctgccggtgccatccactcccagggaaccaaaccagcaggacatcgtatggccgttgaaataccatagctgcaggtcgttatattccgattcagtaacgagtcctttgcgtgccagccgaagggcgtcatcttcattgatcagaggatgagacagaaaatcgcggtaaagaatatcggacataccaagcgcctgctggtaggtaagcgggttgggattgtccagccaccagcgggtcagcgcttcaaagtcatggatgactgggcggggcgtaaggctgcggaattgttttaaaaaagcgattactgttttcggagcagctggagccggtacaggtatttcctgcacacagtcattgagaaaggcaaacgcgattttttcaccggttttgtcctccagcatcagtccgaagcgtgacaaaggagcgagcaggaaatgctctagcgcaaagttttcttccagaaagcgatagactttatattgttcgatggtgtggggcttatacataggaaaccctcctttccttgatctacccaataaatagggacagaaggaatgtattctgcaaaatataaggaaatcaggcgtttgtcattgtgatttgcaaaatgccctttaagaaagcgaggtggctcaaaaccacctcgcatttttaggattcagaggacggatcgggatgctcctccggctcgctgattgcttcatagcccaaaaagctgttcgttgaaagtgctgcgtccagatagtcatttccaacgacaggccgtgaccctttctgaaagtaaaatcggtagggctcgcctattttaagcagggccgatttactgagaagcagtgtgatctctatgccatggctgtctatcagatgtactttgcggtagcggcggagcataggtgtactgataccggcgcagatgccttccactacctcgtagttcttatgtgttgcagtcgcccagatccctcgacaggatataagacaggcgcagagtacgacaatccccaatgccagcaggatatgatctttagtcgccacacagatgatgacgctgattcccgcactggcgattccggccagcagagtgagcagaaactttcgctgcaatacagtgggaaaaagagtccattgtttcatcatgctcataccctctcaaagataatctgctgccgcagataaagattggcaacggctaatgttaccggcttgctgctctggctgattttgaccatgcttgcaatgttgtcactggtggtcgtttcatctccgtagagggaatccaaaagcgcacattcattggggaggcgggaaatatttttatctatgcacttgatgatctctgcagtggagagcagggcttgtccggcaaggcgcatgaccagagcttcgtatttggtgcgtttatctttctggaacagtttccgcgcagcggataccggaacatgtgccagcagcgtcagcttgacaaaagaggcgagccggaggaagaacggtccgctggttgggataatgctgagcgaaccaagcaggtcatacagagcatcgtattctgtttcaccgctgccggataccagaagaccgcgggtaagcagtcggtttgtacagtcttcccaagaacgctcggtacagtaaccggatgcggtggctagcttttcgtattcttgtgcgatgtcatcccagcgcaggattctccagttgagcatgctccaaatcaccatttcctgcatatcgaccatgtattcctgaccgcctaacaggatgattggacaactgcggttgcagccgtttgtccttcgttcaaaccggccgaccgcagtgtatagggttttgattgccatatttcgatacctcctttttatacatatcccttactgttattgatgctgattttcaacaaatcaaagcaggcaggttaaaaagtcagggtcattgcgaagtttttccagggagcgggagatccaggcgcccacatgggaaggagggacttgatagagggcggcgatgtctgtaatgcgcattccctgaaccttcagcgccagtgcttcgatgccaagtctggcaacgccctgatagttctgtttgctggcttccagcagatcaagggtctccagacgagaaaggtgggagtcaaaatggtcatccggctggtctacctgctctccatctgcggccagctcgccctgttctccgatgatcagccgactgacgtgccgcccctgactacagatttttcggcagtaggagaggagtccatttttcacaacctttttggcgtaggttgaaaactgcgcctgtccggcattgtaggtaaaagcggccttgcagagccacaggcatccttcctgaaacagatctccatactccagaccacagatgccgggatttacatggatgttgttgacaatgacccagtgaacgatggataggtttttttctaccagtgtctgctggtctttggtaagcttaaagttttgcttcatcaggcttcacctccgttcaggcagcacgcccggatgtgtacgccggagcctgctgacagagggaaatgacttgctcgcacatatattcggaaaactggccgatgtgggtctggtgtgcatccagccccagtttggcttgcagccagatatagacctcccatttttccatatggcagtcctgctgcagtttttttagggcacgatgggccagaatgcgtttgtggcgcagatcgccattcgccagtgtccccatggggagcaatgtgcgctcatgagcactgacataggcattgcaggccggccatctgtcgcagacatacaggtacttccctctggtttgcggggtagatccatacacaaggcttgcaggtcgaagagaagcgtgcgcatgacagtacggacatttgatttgcttttgtttcaataaaatcacctccattacgcgccgatgacggcggcattgcgtcttaacaggcagaatcatccgaagtaggtatcccggtctgggcatagctgtaaaaacggacatacatggtccgaagaggtatgccattccagaaacttggtataagcagtccggaacgagcggcactccagaattgcagagcattcttcggggtccactgcttctccactcagcttccgcactgtctggacggacagaaagatcggctgacagcttgcgtctgctgccatcaggaacccctcacaggatgcctgccggatcattggacaaagtgaaccgctgcagcggatgaacagggcgttgcgccagttaccccggactgcctgcagaaaggaatagaactgacacggtttttgattcatgctttcacctccgttattcgttatctgcaaataaaaaagggggccagctgcagaagttctgcaaactggcccctgatttggtgcttaggagaacagactttcaatctcctcagtgatgcgggggatgaccgtatcgttgaagatgagggtcagagccgccaggagcagcgcacccaaaactacggcgataatgatcttgacggcgtccgaaatgtaaaaatcgccgcgctgattggacaatgccatacggccgcggttgagcagatagttggctttgctatagatacgggtcgtgaattttctcatgggtaacctcctgttatatgtttgatgattgagtggataggtatatcaagtccaccgtctgttaagcgcggcggataggcttgatcagattgtttttgttggaacggggccggttcggatatgctttaggccgctggaacagcaagcaacgaaagcggcgttttttggtgccggtatcattcggcggataaaatttctttttgggcataggcattctcctgtaaaaaatgaagccgggctgatgaaacagtccggctcagttcagatgaaaagaaatgatgtgcctgccgctatggaaaatcgcttgggtacaaacgctcacctccctgtgtatctgtcttccatatgaggagcaggtatgaaaacgcctggaagtaccgtggcggatgccgattagccaaagaacgccccgagcgaactcataacctcggtacagagcaccaccaggtagatgatcataatacaaatcagcatcatcatagagtaacgctggatctttttgggacgtttggcagcttcctttttcagattgttctgctcgatctgacgcatatcgaaggtaatcattttgaagtacatccgctggtcatcaccgcgcaggacaccaatcaggccacggatcacatcggacagcatggggctgccaatgcgggtttcaaatcgaatgagggcattttcatagttgccggtcttcatatcagcaatggtctgatccagttcggcgccgaagtctttcccagccacacggcggtaggaagtcagaattttaagtacatccctgtcattttcaaggctctggccgacggtcaaagcaaatcggggaatctcgccctcgatcagcttgcggcgctttttaacaaaatcaaaggctgcatagtaggttgaaaaccacagtgccaccgcaagaccaatcaaaataggcaccagcagcggaataagaaatgccatggggatggcacacaggccgactgcccctgcagttacccaggctctggccgtatagacctctggggtaagctgcagacctgcaatgtccagagcgcgttgtaccttattgcgcttgagccggtccagccgcaaataaggggcgatccaaccggcgatttttgtcacatagacatcaagcagcttttcgtttttggtgccctgctgtttgcgggagagcatcatcatttgtgaggtcttcttggtcgggatatccacaaaggcgcaggtcaggttgtagacagcgaaaccgaagaagatgatggcgatgagcgccagaaaagtcatacgctatcacctccatattcgatgggcttgctcagtttcatgatctgtgtcagcgaaaacaggatgatggctgcacagatcgccagtgcaattttgcccggtgtggtgaagataagggtgtggaaccaatcctcattcaagaaatagagcagcggcacattggcgataaccagaaatatcatggtgatggcttcacgccgcggcccttgcatcattgcctccagttccgactgcaccacacgcacatcggagaatttctggttgatggtaggaagggtattcttcatactgcggtcggactggcactggatgagggtgccgcaccattcatggaagacccggttgggaatcttcatcttcaggctgttgatagcgctggtgatgttggcattgatcagttccgcttcataaacgaaggcttcaaagttggcttttaccggctcattgatatagggcaggttttccttgacagaccggatcagatcctcggtgcgcaggtaagaagtcgtgataatggaaatagcggtttccagttcttcattcaggtgctttttatagctggtggcagtgctgcgcagataccagatcggtataagggaaaaaccgatacccagaatgggcaccatgtacacattcccaatcaaaagggcaagtacagcccccaccgcgaacaggatcagggacagtcgttttattgcctcatagcggtccgcccgtccggtgcccttcaaaatctgtttcagttcgtaatcctgattaaaaaagcccttggctggtgtgcccagaagaacattcagttcatcagacaaggtggcggattttcgctgggagcggaagagggcgtcaataaaatcacccggtttcacaccaaacagagccaaaagcccagcactgagcaggataaaacagataagatagatccattgcaattaacccacctcctttggcggctgcatgaattcttccaattccttgttggaaatgccattgtccaacagccttttcttcaaggaatcggagatcaagccgatttttttatggtgccctaccacacgggtttcaccacggtcatcagttacattgtcctccacttcatatttgtatagggaatgggcgatcagccgcccgtcccggtagtcctcgccctcaatgatttccatgatcttacgggaacggtcctccagctgcttggtaaagacgatgatgggatacgcctctaccatgatctgcatgaggatggagtcatccatgttgtacttgcgtttggcaagggtcatcatcctgcggtaagtactgttgcaggaattggagtggatggtggtacatacggtatggccggtgcgggaactttcggctgcggacaggctttctgccgctgaccgcatttcacctacaccgatgacatccggatgcttacgcagcacccgctccagaagaaaatcctgattgatgttcaacgcagggttctcgctggggcgggtcagcagatgtactacggaattaaggatattgccctgcgcatcccgcttgaccagatcaaattcgcggctgccttcttcaatggtaataaggcgccggttattgggcacattggacagcagccaggccatgatcgtggtcttgccggagccggtagagcctgcaatacagacggacaccccatagcggatacatgcagtcagaaagtgaagcatttcagcagtggcactgccagagttcagcagtttttcttcactgacggtctgctggttgacaatacgaatggaggcattgacgcctacatccgcatccacaatgggagttttatccaccgaaatacggatgttcttgtccagaaatcccacaatgctgggcatggtgtcatcaatgaccatgccgcaggcgttgagcatcctgcggatcacatcgatggcgtgctggggcgaactgaatttatcagggatcttgatgctgcgcccactggattcgatcacttcaatgtcgttgtaggcgttgatgttgacctcctcaacaccgggcttatagatccatttcttcaaaaaggaatagccggccatgtcttcatagagcttggaacacagttcttttgtagagagcccgtcaagggcatatttgcgtttgacaatgtagtgttccatcagttctttcagcaggcttgtggcacgctctgcattgccttccccagcttcggcaatggtggaggcatggttttcggcaaaataccgctgtacatcctccagtacctggtcataggtcaactcctgattggcggccggtgtgaagaatatatcattcaaattactcatcggcatcctcctcacattcatacgccgcatcctcctctgactgctcggccagttccatttgctccagaatttccagtaccttgttcagtgaagcagtgtatttggggttacagtaggtgatagccctgaacataccgccttcggtagcacatcggtcgatctccttactgtagggaagcaggccgtcaaacccgccaatgatatagcccatttcatccaaggcgtggaagggacgggccagaccggcgaatgtcatatgctcagaaaaccggaagcgctcgtccacaagcagaggttgatgggctttcaggtagttgatgccctttaggtccggggtgaggatacggatgaccacatcgccggcttcaatggcggcgggagtgaacacattggtcatgctggtgctgcagtccagaatgacgaaatctaccagtttggcggcagcatgaatgagctgcagtaccatggtatatttgacctctgggtagctcagcgggttttctcctgccgcatagcccatcatcccaatgaagggatagtttttcagcactgtcacatgactggcaaccagagatgtatcaatctccacactgctcaaaacctggccgatagaggtattggtctggatgatctgctccggcagccagaccggcagcatagggacattcatatcggcattgataatgatggctttccgcttgtcccgggtcagggctttggccagaatacagcagaacatggatttgccgctgccggggcttccccagacggtgataactttacccataacgaagatcctccttccttgatttgattattctgccgagggtgcagtttcattagtggattgtgcagactctgcagtttccgtttcctggggttcactttcaacatcagaattttccgcatctgcagcttcttccttaatcaaagtttcggggaagtagatttcctgcagagtcttatcctgctcggcaagcagctcatctgccagtttgtcattgttgcgggagataagagccacatgagctacgccgtcattttcaagaccggtaatgatcttcgcctgttcagggcttgccagcacagtgatggtggctgactgctgcttttctccatcctccgtgggctccttggcattatccacattgatgccgtctgagtctgtgacggacaatactttgacaaaacgcagttccggtacttcggccgccgtatcaagaaagtggtaaatacggatgatgtcaccgggctgaagcttgtcagagaggccggaagcaagtgttttaacggtcagcgagatagcaaccttaccggaagggatgctgttgagcgccacatcggacgaaaccggtacagagctgatcttgttggtaaggatatagtcacccacagccaagtcggcggtagcgtaaagaccatttacatcggagagctgatgggcgatgttggaggggaggttatagccgcctacctcaaccacctcggcattttctgacgagatttgctcgcctttcaataccggctgggtgatacggacgatttcctcttttccattggtctgacgggcgatggttggaagtgccacaaaggcgataactgccgccaacagcagagagaggataccgaagatgaatcggttattcagtttcataagcgttgtctcctatcttaaaaatagttgggccagggtcgctgtacagcagccacaggcgagaaatggcaggaacgggatagcaaggggctgcccagttcgataaagccgcctgagaagaaagatcacaggcattgcggtaacagcggcagtcagaaagaccagcgccatgccggaaggaccatagaccagccctaatatcccgcagaacttgatatccccgccgccaagaccggtgccgtttgttgccagtgcagctgccaatggaatacaaaagccgagcagggcacctaccagggcatgggtagcgaccggccagaggaagagcggcgggagcccatgatttaacaggaaatacccctgcaggaccggtgccagggcagctaaggggataaaaaagacgagtgcccggtcaggcacccgtctgtaaagcacatcgtagacagcaaagccggccaccacaaaaaatatggtaagcaggtaagctgtccagaggttattctcgattggtataccagtcatcataaaggctcccttggatcgaaacatagtcatttaggttgatggataacatgccgtcaggagtccaggtatcccacacctgtgtatagatggtgtagtcggtggcatcggggaaccacagcggtgtgaaatgcactgtccggtcataggtggaaaactcgttgggcttgaagatgaattttgcactttggccgccggaacgctgcagaagccgcagataggtctgatactggaactcaggaaatacggaaaaagcagtttggggataagtaatgtggctggtcggggcatctgtggacagcgttgcccgcacttcggttttaacgccgtacccgcttttcatcgtcttgccggatgctgtgggtacaatatcatctggcattagggacatctcgccgctgatggaagcggagtagcccgtatattcgtattcccaatatccttcatccacccagtgcccgccatcttcaccgtggtcgcaccatacccatacaggcacccagtagcagctccagacgccccagttggcagtgagcttctgcgtttcactgggcaggggcggcacagagtagcctggattggtgtcggttgccacagggtcaggcggaatgtgctcattcagatccacgatttttgcgacaaaggtatcctgagcagtataggcgccgctgacagatactgtaatggtcacggtctgtggggtggagggggtatgccatttcacccagactacctgactgtcaccggctgggatcactatatcattgacccggtaggtggtgccgagaatatggaaggtaaccgatgccggattatccggcgtcagatcctgatccgtccgcagtgtgacagcggtgatcacatccgtatctactcggtattcgacatcaggggcctcaatttctccttccggcggagcttcatcaaaccagacgataccaacgccgagggtgctgatgatgtcggaattgttctgcttcccggtggtgttgcctgtccaggcggagatgccaaggtcactgaattccaggaacatggacagcggcaggtttttatgggtaagcgaggtcatggttttccgcagattgccgccggacatctgatcatacaggccggcttcagtagctgtcatacagtaatactggccgttgtgtgtgaaataggcaatgggttcgatcagcagcttgtactcgccggcaatcatccgctcataatcgactctggctgcctgagcgaccatcatgcacgcatattcagaacagaaataccgtttgatggcttcaatgttgctctgccccttgctgctgacgattgtgggcatagactgcgcgggtttaatgcaggaataggcagcgccggactggagggagagaccggtgccgctcaggtattgcagtttgttgactttcccaaaatggagaagactggtcttctgcgtccggtttgaaaagtccagaggagaagatacggcagttccgctggatgcatcaacaaccgtaatgcggacgccatcattacccggagtccagaagttgctgcttgtgccctgacccatgccgccacctccgccatctatgtttccatttccacccgttgcaaaggcagaggaggggaatagacagaaaacaagggtgaagcagcataggaaggcgagaagtcgtttcaaatacatcacgctccaatccttttgaaaataggaaggccgccacaatcctgtgacggccaagtagtgccatattcagttgtagtaaatcagcccatattgccgacttgtttgttcagatccccatcactgtcaccgttggactgctgtacatctccgggaacaacccagccaaacaccggatcgtatacagctccatttccgttgctggagccgggagccggttcattgctgggcggtgtttgctcggcgggcggggcagtaacctccggaactgacgggtcgggattgacggtatgctcctgaccaggatctttgatttcggtcttaccttccggcaccggaggaggcgattcttcaggcttttcagtatcggtaaagtcgatcacaacctcatcctccgtttgggaggttactttgggatattcttctttggcatctgtggactggccgggagcataagcatctgctccattatcaccatctgtctgtgtgccgccatctgaccaatcgccggtgacgctgctgggtggggattcatccggcctaaaatctctggtacggtcgcggcttacgaaccagcagacacccagaatagtgacgcagaggagagccagcgaggaaacaataaagcctttggattggaaaaatttcttcatattttacatacactccttttttgctgttatataaagcctatacggtagaatgtgccgggctttcaacagtattgttagaattttgtgttgtggtagcctgttagctccacccgttgggtgatagccggataactgtggccgaacatccacacatagaactccacgtcacagtaaaagatgtactcaacccgtccatcctcaacattgaaatccaggctgatgtcggaaaccttgtaatcctccgttgaaagcggaatcttggagtccaggccacctgccactgtagcctccagcatgtcggtatagtcactgctggagtaaagggtatttaggtactcttcaaagttggtctcacgctgggagcggtaggtgtctgcataaatcgtgccgctgaggttatttaactccattttagcgccgttgcggatgttgatgcaggtgatccggatggaagcatacaggagcaggaaggaaatcagcatcacgatgcctaccacaaaaaagcaggcgaaaaaggtgatctcgccccgttcgtttcgcagcggctgtttcagccgcaggaatatgcgtttcataggtcacctcacttccagtagtgctcactgacgccgctgccacgggcaaccactgtgatgtttaccaggtcaaaattccagaacccgcctagtttggcatctccctcgatagtaatgaagaagggggtgcccaactggatggcatttgtcataccggatggcctggatgatgtgtaagtagcgtcaatggagtaggagatattttcggctccttcgatctgagaactcaaaaattcaaacagctcatcggtctcgccgttgacgccgccggaaagctggatctgtttgaccatctgatcggcagcatggtcaagttcctgcttggtggaaataatgctgaacaggtcaataatgaaggccagcagtaggacagcgatgaagatgaagaccaccgtactgaaatagttggcctcgccccgctcgttgttcagcattttccgggctttttgaaagagaatagaaaccaccacctttactgaaattgaaaacagccgctccaaaccggagcggctgctatgcaaagttttgactgtaccaagtataacagatatggatttacggcgaaagggcaggactgtgccaatgtagagacaattttgtgccaaccatgtttctttgaaacattacagcagtgattccaccagctgatagatgtcggtaaatggattgacagcaattccaaacggtttgctgctgtcattttgaagatggtattgctctacacgtttggcgttctgaatcgcaatggctgtatgctctgctaactggttatatacatcgccagctttctcataatcagggagataagtggtcaatgcgtttttcactgcgggatagtctttgaaaaatttggtggtgtactggaaatgcaacagataccaaaattcaaagcagggattggagagtgcaatctgaatccccttcgcatctgccattttccttgccttggagagcagactgtcctttgcagtgatggggtcagggttgttgtagttcacatctccatctgcaactacccatacagagtctccctctgatacggaaatctgatttttgttctgatattccacggctttcctgatcaggctgaggtaatcagtttcacctccgctggtgcggctgccgaccacacgaatatcaatgtttgtctgacggttgcggtagtgttcaaaatacttaggctcagtttgagaaccctccgttacaatcagaatgacaggctttatttttctgcgtcgctgtccgcgcttttcaatttttccatgtgccattttacagccctcccttgataaaggggatcgcaccataacggccaatcagatagcccttctccaccttggcatccttgcggatggaaaaatcgtaaagggagaacagatcggtagccgctgtttgctcgtctttttcggtaaaccaaatctgatctctcctcagtacatccaggtcaagaagattggtgttgtgtgatgtgaaaatcaactgggctccatttggattgaactccacgctgttaaaaagcgagaccagatgctttgtcagaagaggatgcagatgagcgtccatctcgtcagcgacaagaagggttccttcatccagcaccttttttacaacaccgatcagtttgaaataactgttggtgccatcagattcctctgccatgttcagcgcgtaggaagaagtatttccgtctgtatcctgtactgtgtgaatggcctcaatattggtaaagatatcattgcgctgagaaggagcgggttctgcatcacgcatctgaagggactgtatgccaaaatctgcaacacgcagcatagaggcgatcacatgccggtagtcatcatctttgagttgttctgcttcaaggccgtaggcgtctgcaacagaatttttcgtgatgatctggcaggaagcaaaccattccagaaccggaatcactttggaatagctccagtttgatgcgacagacagatagagcttgttggccgaagtgcgatccttgagagtgttttgttcatcgacatcaacggtaaagcgaaaatcttttgtgtcttttcgctcaaaaatgagtgcctgcctgccattgggatagtaatacagatattcttcaataacagctttgtctgttacagaaaagccatacgcatatcggatgccatttgtggtgaagatgacctcaaagctgctggggcgagagggtgtttcccggtcaaacttgaaaggcgaacgctcaatggttttgtggagctgctggttatgcgacgtcagcacataatttaccatgaaccaaaacgcattcaggacattggactttccggaagcattggcgccgtaaatcacggcagacttcaaatgctttttgtttccgtccacaatcaggtgctccggatgttcgttatccttactggcaagcagggataacacgacattatctttgatagagagaaagttctctacactaaattgaatcagcataaaacaacctcctaaatccttgttataatatattatatccgcatttttgtgaaaaatcaacgaaaatgaaaaataaaaatctatatagagggtttaagaggatggttgtgtggagaggatatgtggttgtcaatcaaaaatggcaaccacacattaaattacacataagtaatgtgcggatgtcaaaaatttaatataaagaaggtggtgagccaatgatagaaggcagcctgggaagcagtttattttgctccccaggctactttcgcttacaggttctgccggatgatccgggtgataatacctacggccacaccccgctccatatccagacgggtgacagcaaaagatacatcgtcctttttgccgggcatccggtagtcatagcaggagtgggctaccgcattgacgccattggagaggcgcacatagacaacgcccttgtggacatctgtgacacggccggcatacttgccctggatacggcacttctgcaggttgtccctgtcggtgttctcggaaatactcttgatgtcagccttgatgcccaagtcctccagactgttgcgccgcacgctgagaatacggaccagaacctcatcgcctacggaaaaacgctcatgggcgtcaccgatccagtcccaggcaaggtcacgggcaaggatagaggtttcaacgccgaaaacttccacgcgcacaaccttttcggccactgcaatcacacgcgcctggacgatgcgcccctcatagacacggtacataccggcagcatccgtatccagatagaaaatctggcgtttgcgcagcatggcctcctttcggctggcaactacgctgcgggtcttggagtcgataccacgcacgatgaagtcaatgtcagcaccgagcatgttgccaaggatcttattttggcgcagcataaggtcggcgtattcctgaccggaagggctgcggcccagattgatcatcatttccttgatagggataataacacggaatcccttgtaatccacaactgccaccgtcttgcggttgtccagctgttcaatgccgcccagcttgccggtgatgatcttgcgggtgcggtaggcattatggatctcatgccagattacatcatcccggtcttcggcagtctcgacatcatcccggctgcggatggtaaggacgggggcctcgccgcgctgggggcggggctggcgccggggaggagaaggagtgggggcaggagcggcagcttcctccaaggcagaaacgtcaggctccacagcaggttcctccgcatcagggatagtatcggctgtagccaccggatcggcagcctcggcagggacttcctctgtgacaatttcttcaggagcagcagcttctttcttctttcggctggtacgcttgggcttgggaggtgcagggggttcctgcacagcgtcggcattatcttcgtaaacatcaggcggctgcacatcagagtcttccggcatatcagtgggagcagcgctttgatcgtctgtttcagcaggcgtatccccgaacatttcctcctcggtgagttcaggaaggggatcttcagccatatcttcggcagaggtgtcctccaggggctgatccatttgccccagcagttcgttcaaatccagaccatcgccagcgtcagcaggaagggattcaggttgagcggtatcggccggcagagtttcatcttccgacataacggtttcggtaacaggagtgtcctgttccagaagttcttttttcttggttgccatagattaaaacctcctatgaatttgatagttttgtttaagacaggatggaatccttgtctgtggtgataatgccttccggcgtaccggcagatttaggggtcggagtctctttgggtgatttatccgtgggggatgccggcttggtggctttgcgctttgccggtttctttgctgcaggagccggtttcggcgtgggttgcggtgttttggcggcttcttcttccaagcggcgccattccggcacatgggcagatgctttgcaggaacgcaggtacttggcttccgggtgtttggagtaatccattttgtctacctgcagaaccttcttgccacggatgatgatgagcgcctgatccagcgggagccgcaggacttcatcaggagtaagtacagggcgttttccaacaccggaggtctcacgaaactctggtgtatagttggagatacgccaggtgcccagctgtttggatttactggatactgctacagaggcaagccctgtcctggcagaaataaattcggcagtaagctggtctgtacagcctaaaaacaactgcgcgtcacagtttccaatgatttcctgccacaaattctgcgggtatctgttctgcaatcctgcgagattttggaacacacaggacatggagatattccgggatcgtattacgctgagccggcgggagaggtctgggattgtgccgcacgctgtcagttcttccccaaggatatggacaggcacaggcagtttgccgccctcgcagttgtggtctgcatatcgcaccaatttgatgaagcagaaagatagaaacagcgaggccagaaaatcaaaggtgctgtcctggtcgctggtaacgaggaagtaggcacagggctgctgacccggaagttccagatcgatctcattcttagcggtaatttttttaatcagctcagactggaatacctgcaggcggctgcccagaccgataatcacgccgcttcgcactgtgtcgctggcctgcttgaacaggctgtagggtgctttggcagggtgcgtggaaggaagcgcctcgaacaatgtgtcaagttgggattctccattgagagtcagcagccggtagacttcgccaatgttgcggttttcttccgcatagccttgatccacatacagtaccaaggccttgagcagattcatctcgcaggcatcccagaaatggtcgctcttgccgttgttcgtggtgttcttgatgatgacatctacaaaaagctgggccattagttcctgtccctcaacttcggcaaggcagcaccaggaatctgagttttcaggcgaaacgaggttgaataccttgacacaatagccccggctgcggagaaattcgcttgacttctcgtacaattccgatttgggatcgcagatgatcagcgattctccggcgctattttcgcctcggacagtggcctgaaggatacggttcatacaaaacgaacgggttttcatggaaccactggcaccgtagacggccagattgccgttgattctggtatcttccggtatgcagactgctttgccatccagcatacccagtacaacacccttgtgttttcgcagatcaggcaccagatccagtacgccggacatctctttgcgggacatccagccggaggtgccataagtgcctttggcggagtaggagaaattacggtcttcatcatactcgccggcatcaccatatcccatgcgcatgaccatgatgagcagcactgctaacaagccaatgcagatcaagatgccatacacgccataaggcggtcggagcacagaggaaaggcagagaaggaagtcgggcgaagcggccagcggtgaagtaccatcgccgggaatgccgccgccctgtttccaggttgcatagttgcccaaaagctgcgccagaaagccgcctgcgtataggatcgcaagaatggcaaagggcgctgcaatcaggctcacgatcagttttttcttgtttatgggaacaacctcccctcgaattttgtgaaatcaatggtctggaagcgcacccgggaaccgcagtagctgcgaagtacctctgcctggaagtcaaagcagatcagtatgcccgggcgctcggatagttcgagagaggtgttaaagcgtgcgatacggggcagatcacagaaatagccaaacaggactggtgagccgtccggtgaaattccgtcatgctcaatagccagtccgggctgcctcgcagtaagaccttggagcagaatgcgatccagctccgcagttttcccagggtcgcacagcagtgcaagtatcacctccccctgatggtcgttggtaagataaagaaaatgctcatagctgccatccagcatgaagaaatcatgtttgcgtcctccggtgctggtcaagatctggtaagccagatccatgctgttgcccagaatcagtccatgaacatcctcatggcgaaattgttgggacaggcgctgttggcagattacgctccagatcaatgccttgacccgcatttccgatttgtagcgccacttcatcagggcgttgctgctgttgtaggtcacgaagatgccggagggcgcaaggagtattccagtggagcgggaactgcggatcttcgtggtgtcgatccccatttctttcacttctctggaactgaaaaaagcaggatagacaatcctgccgccagcgtaaccctccggcgcaaaaattgccggtttttcatcccgatacacacatacacccgcattatccatggtcacataggtttctgccaggcggtgtagccggagtcttcggtcaatttcacatttcaaacggttggtgtcggtatctcctgtcaggtagctggcaaacctgtccggccggctttccagcagagtggctttggctcgcggccccagacggtagccgcgcagtttatcccggtaataggtacgcagcagcccgtcttttttcagtgcagtgacaacagactccagataatacggactgccgggaagtctgttaagctggtctgtggggaactcgccggagatggcagtcagagagagaagcctgtacgccatcgtgtctggctgtgggaatttcccaagtgatcacctccttgtggtgtgtggcttttaccgagactgcaaggaacttcggtaaaaatccgtggtgtaacgacagaaaaaagccccgaaatccggggcgaaatacggtgttgcggcaggtcggacaagcaatggctgaaaatgctcaaaaatccgagatggattttagggtgttttcatgctcagcaagccaggcgggaaaccgctttttttccataacactgattctggtacagtccttttcgcccagcgcagcggtgttgtaggcatcgcagagcaggccggtatcgtcagccatgacgaaggtggagaggacatccagaagctgcttttcttccagattgtcgtagtcacggatacgccgggtgggaaggcactggtcataaacctgcgtaaagcacaccacacaatcgctgaagcggggcatgggatgctctttggcgtattgctccaatgagaagtagaacgggtcgagcagaaactcagtgttttgcctctgcttgcgttttgggagcagaccaggcagggtgacctccagaacaccgtcctcatagacaacctcaattccgtgtacaataccggcggatgtcaggtaatcgcctttgcggatggtggtgctggaatatatcaaatgccgcagcctgcaggcaattttctctgcccgcagggcggcatcagtggataagacttcatagttgtccggatagcgctgaatatctgtggtatccatcgcgtaaagagcattgctcaaacgggatatatcatcaagaatgcttccgattcggtgtgagatgatttttcgttccaatcaagttcctcctgttttcttaaagtaatgcacctggcccgctgcatccacggtgcagaaaccggaaatgccagggcagtcaatgcggcgaatgtcttccggattatcgaccaaaataatgcggtgtccaccgctgcggtcatcccgaagcgcatggttgattagggcctcctggccggaagctgcgtagacgatttcgtatagttcaccgtttgcaaagaagataagcttgaccggaaaatcaccgggagcatggtattccacctgcccgataaaatccaagagtacccaggcagcccgtatcagggagctgtccgattttgctgcccaaccagacggaaagtaaccgcctgtatcagtttgaaaaatacggccctgcttttgcagatgggagagcagggtcttgatgatttcttctttgccagggtgaaagcagagaagctgctgcatattgagaccgggatacatcgtgacgatccgcagcagagccgcagcttcatttccatagatttcagccctggtcttcatgggtatcacctccaatggcgtaatataggcgtattcaagacgcattaaataggaaggaaagccagtcagtgtaagccaaaaagatgatctggctggcaaaactggcttttaggcgtaatacagacgcaaagcagacgcatagcggcgtctggcaggaaagttgcacatgggaatcacctcgcttttcaaattgttatatctgctgttcggcagatgtggattgttcacggcgttttcgctctacgatttcacgcagctcgcggcggtcggtagtgatcagatccttttccagagggctggctttgaactccaccataatattgttgttattggtagaaatcagaccgtgacctctttcaaagtgagtgatctccattgtttcagcatcggacaggtgaagggcttcctgtacccgctgggcttcgtcgtcctccagattcagaatgatcttggtcttggagttgttgatgatgcccttaccaaatctgccgccgtcaaggtcaaagaaatcggcaagatcctggcttgcaaaaatagaggcgccgccataaccgcgtatggttttggcaatttccaaaagaaaatcgccggccaatcttacaccagcagcaccggcaccggatagaagctgccaacactcatcgatgaagatggctttttcttctgtacggtcggctttggctctgtcccaaacaaagtccagcgccacaaacatacctacggtgagcaggtctccggtgagggaggaaatatccaaaacagtgtacttgttgtcgagccgaacattggtctgcttattgaaggtgctggcgcttccgtttaccagacgatttaggatgtgggccatgcgcatcgtttccttggaggttttcaaaatttcgtacaggtcaccaagcaccggcatctcacggtactggccgggctttgtagggtcttccaaagaggcattatcatgagtgatgccttttgtgttataggtacgaacaagggcttcgtccaaaagctgtcgttcctcgtgagacatatcggggatcagcagactgaaaaatatgtggagctgctggatctttgctgcaagttcagataactggatgcttggaccgtccagaagttcattcaccgagcggtctacccgccggatttccatgacattgatgcagtggggactggctggtgaaatctggataaaggagccgcccacgttggagcaggcgcgatgaaattcatggccttttaggggcgcaacaatgaaaatggggatatttttccgcctcattcgcagcgccatcaactgcatggtaaaggttttgccggctccgctcgtgccaaggatcgacatattggcgttcttatagaccgcagaattgaagatgtccacgataataagggaactgttgtacttgttgacgcccagcaggataccgttatcatcacacatctcataggatgtaaagggataacagcttgcggcaccgcctgtcagcaggttgcgcttaccccgctcatacagtttcttttccattgccaccaatggcagggcagataaaaacgcctgttcctcccgaaaatggcaggtgcaggcgttcatgtcctgtgagagcaggagctttttcatttcgctgaccttccattccaagtcttcctcgttggaggcagtaatggtaatcagcagattcaagtagtagaagtcctcgttgttggcaaggccctctttgagaaagtacccgcttcggatcgcgccatcaatgtcatcaaagtcggtgttggtgtcgctggcatccttgattttggaacggttgatacgcagctgctgtccgactttctggatgatggtttctttgggttgacgggagaggaacatatccatatcgatcccatcaccggcattgacgataagactgagccagccggctggaacctgcgttttgtagccatcagagggcaccagcaaataagcataatacagaccgtcaatgcagatatggtgaccatgcgtgaagtcaatgctttttggcgcacagaattcggtggcagggatatggtcgatctcactgtcgcgccctttggcaaggtactcagccacaacctcctgtgcccggacggagagcggctttacagcactttcatttctgcagagcaggttatagaggacatctatggtaaactcatcccagttttccggaacgatgacctcgttaccgcattgacggaggtagttggtagcagtatggactgcactttgcagggcattgattgcctcgccttcttcatcagagcgcttggtgttgctccacggctcatattcaaaaatcaggaagaaacgtcgggtaattgcctcacgggaaccgatctgctgaacgaactggaggtagtcttcctgcatgagcagacactgttcattggtctcctgttccatctccttccgaacggtatccagatggcggttgatctctgcccggcgtgtcagtaccttgatttgcagcttgatggggctgattttcaagtaggagacaaaggaatagatgatgttccgctgttcctgggcgctgcgcagcataaaattgatgggtactacctcgacgaccttgacatagcggtggtcctttgtgtagatgatgccgttttcaattttggaaatcggcagataatctgctaccgggttaaggtaggcgggcttcggatcctgagtgcggatagggcgttttactttgcgctctttggagaccttctttttttgcttggcggctttcttctccttggcaggcttctgctttttcacaggacggagtttttggcggatctcgtagctacgaacttcatcaaactccgctgggaaatcctctctgccggagcgccgtgaccgtctgggagccttgtcgggcttgtgtaccttctttttaatatgcttgccgccatgctctgccgccggaaccgcatcttctgcgctgttaccgcctataatgcggcggtttcgcaggtactttatgaaaatcagcagaaaagaggaaaggctctcaccggaaattccgataagcgccaccaatgctgctggcagtgcggtcaggcacaaagcgatgatacgggcagtcaggctaagagggagcaatgaaaaaaccggcacaccaatggcaaatgccaggatgccggcttcaatcacatttcgggctttgaacataccaccgaagaaggtgcctgactcgatgaaattcggtggtattatgtaggtatctcggtcgattttatgattcatgattaacctcgtttccgaagccgggcgggcacatcagccgataatccagaacggaccgccagctccagcgcgccggctggcctcatttaagataatggacagatcccagagctgttcgctccgtgtgtaactggcagggtcagccaccatgatcttgccgtcttttacgccacgcaggacaatgaagtgaccggatgaggtaaagtggccttcagacatgattgctactaccagtttaccattagccagtgcgtctgtgatgcgctgtggttccgcagtggtacagccggaaaccggaagcccccattccccagcggcggcaggtatcagtgcatggtaagaaccactgcttttacaccagtagccgttgttgtaagaccactcggccatctccatagggtcaaccatatcgtctgtcagagaggacaccacgattgccatagcggtagggccgcagccataaccgccaatattgtccgtgccataggctttaccggcatagcgttcatccagctgattgtagtaaacaacaggtgtgatcccatcggtgaaagtaacatcgcccagagaggtgatgctgtttccggtccacgcttccagattctgcagcagaccatcgcccaagaacaggcttaggttggaggcataatcggctgcaagctccttttggtcatcggtaagctggaatacaacatcagaaaaataggactcaccgttgtaacggacagtatagaccatccatgtttctggctctgttgtttcttccccagtctccggatcggtcacggtgctctcacgaatctcttgcttgctggtgtaggaatatagatgctgcttgttttcccgcagggtggcggcaaggtcatttagagaaatgctttcaaaatccttgtctttggctgcacaatactgagaaataaacaggttggcgttataaataggcccgccggaataagcatttttgacctccatatggtcggctcccgatgccgcaaagtcagcttcgatccgggcaagtacatcatccagtgcctcgcccaagatgccgttgagggtaaaggtgatctcgttggcgttctcaataatcgctgtttcgctattcaaaatcggaatttcggggtcagatggcgaaaaggcattggtcagtccgccgaaaataagaccggggagcatgagaacaaataataccggcagcataagcagggcaatgactgccacaatgatttttccgatatgcttccgacctgcccacactgcgcctgcaactgcaccgtaaggaccgcctgcggcagcgcctttggcagcggaggaaatagcttttccggttttgattgcaccgcggatggtatgcgctgcggaggcgccggtctccacagcttcggaaaaaccgcttttctgatcttctggcatttatatcttgtcctttctcctcggggctggaggcagctttttgacaatggactcgttgaaggcgatagaaccgtcaggggccatatagggcgatttgtcaacagcatccacagcgtactgcttataccatgctgtaccatccacggcatgaacggtggtgtactggccttccggggcaacatattggtctgcgtggtacataccaaaggagataccttcgggatgttctgcagttacttctgtaccggtgatgcggccgccgccgatttcgacattctggaaggtcggaacattttcagctccggattccagtgccgcgtatcccatgtaagagtgcagggcttcggcggctttttcaccggaaatggaacccatttggctgatactgccagtggctacgctgccgattacattgttggcaaaattgccgcccttactgacggaagaagcgtacatatggccgccgatccctccggctgcagcatcgcctaaaagactgccaagaccggagggcttggagccgggagttgtggtggctgttttgatggcgctgtttgtgacttttcggctcaccactccagcaagaccgccgctggcaaaccctactccaaagccgccgctgcctttaccaccgtttgcgttgacattggtggaactgctgttcctcccgccgccaaagtggtgactggaaaagttcttgatgccgccgatgcctctggcagcaatcatagcctcagccaacatgctgccgccggtatgtcctacattgacacccaggctggagaggaaagaatcgattttctgaccgactttgagaaagccgatagcacagagaaaccagataaacacattgccggaaacggcttcttttcccacagcgtctacctgagcctgcacatcgctttcggagatagcggcaaaagccggctggcagagcaggcaggagagaattgcgactgtaaaggccgcaaataaaaattttttgagtttcttcaaggataagacctccttataacgaaagcgggttcgcaaggaaggaccccaccatgcttgtgaacaggcgcaggcaccaggcgttcatgaccaataggaaaatttgaccgccaagcatccggcaccaggatttccagatgtttgctgtggtctggctggcgcccatagaaaaagccacaggagccgtgtagaccagtacaccgagcagcacataccgttcggctgcctcgaacagaagttttaggtagttccaggccaggatgagaaccaaaatcaaggtaatcagtgccacagccccattggcacacacaccgatgatgaccagcatcacggaattgaagtctgcaaagcttaatgcaggaaggtcggactccatgatccagtggtagggggtgccgccgatggtaagaacaatattgacgatttcatctgaaaagagcgtcagcaggataaaaataacggaacggatactcagctttaccgggtcttctgcttccacacctgcgccaagaccgaagtttttgaataactgccagacccagttgagcaggatgatcccgattgccagagccacgaaaacagagtacatagtctctgctgcgggaaaataacgcagaaatacagccatatcacagcccagcgcacccaaaaccgatgtggtcaccagatcaagaccggccattacctgttctgcgatccattccactatgccgtctaaaatgcccataaatgcaagcctcctttccggcgagcagtcagacggtcaatcagcctgtccattgtccgccactaaagagcggcgtcacatacgccatgataaagcccaagccattgaggatagcccaggtgatacagattcgtttgagccaggcgcggctttcatccaccgtccgtccggaacgggagaagttcatgagcagcaaggctaccgaagtagtgacgatggcggcgatagtggagatggcaaggatttgggtgtatacatcctgcatgatctctttggccttggtccatacatctgttgccgcataagccggctggcagaatatcatggacatcatcacacacaggaaggcgctgtaagccactttgggcagcgaaagcctgcgcttggactgggtatccggctcctgaagctgcggagtttgaggggttttcgttttcttcaatttgcgatcctccaattctgaatgattttttgatgctcaatagggaacagaaaaacccacacctgtcaaaacaaatgtgggctttcaaatggccgggcggccatctgggcagcaaaaaagcaccctgatgaaaggtaccgttactgtcctgttcggttttgggtgcaagtttgagcatattcagtttaacacatcggtatttacactgaaagagcagaaccatgccaattttgttcccgaattgtgccaattatttgcccgattgtccggaagatgattttggctctgggaagaactgctccagcatgtctaaactgtccttggaggtatagccccaaagaacggaactgagggcttcaatggcttcccggcgtttgcggtagtaagttctgaaactgatgtcgcggatatgcggtcgcagggtctcgataatttcctcaacatttttgagctgctgcggcgagaggaaggagtagtacagcaaccagtaatatgcctcaccgtttttgtgcttggtacgcagcaattcgattgcggaatccagcagcttgagcattttgtggctgcgttcaatgcatttggcatgatgctcgatgtcgcttccggccaaatcagcgccagccagatagactgaatccagaaaatcctcaatggaggtaccatactcaatctcaaacttggtgcggacatgctggacagaaagctccaggctccacacaacatcccggtattttttcagcagtttccaggtatcatggtacaggggattatcagcaacatcaggttcaacaaattttctcatttcaggttcctcctattttcgtgctcctcagagggagtgagtgtaagttcaaaagtggcgattgaagtgtttgtgccgcagaggatggtcagaccaaagtggactgtagatttccctcgcgcacgcggaatcaactcttcccagcagtcgtccgataagggatataacttatagcgggagagtgggcaagaaaagcaggaaatcccttgcgtagataggatgtcagccatcttgcggagtatcgtttcaatgtgcgattttgaaacgctggaaagtgcatccgaaacaatgacctcatgctcagagatagaatggctctcttcggtttcagcagtttccggaagctccagatgaatgtttaaggtcatggcaacttcctccttgtcgattaaaacatcggaaatctcaaacatggtggacaggtagttctgcaggtagatcacgcttccatgccggccgggaaacgacatgatagagatatacccaagaccgtccagctttttcagtatccggcatacggtagcgcgtgacagcccccagcggcaggagagttcggtataactgaccaacgggtttcctgtaccattgcgaaagtaggctaccggaccgacctctgacccctgcacctgcgtatcgttgtagacagcggatacccacagatccagaacgatgtccatttcagagcagcgggcagagctgaccagttccagggcaacagagactggcaggaagaaaaaaccggtatccttttggcatggggcattgtactccagtgcggaattgtggcgggcccagtggaggattttatatttgactacattgccacggcccagcagtgtataggaaatcaagtgctgcttctgaagggtatccagcatggacagcgcctgccgatgaaagcgggtgcggaaccagcaagacagttccttgacggtgcacacccattcgccgggcgagactgtgtaactgatcccgtcaatacggcgatatgaggtgcggaagtttgcatagctgcaaagtacagtaaaatgaaaaaggccggagcctccgtttatgcggatgctccggtcgttgatcagtttgtggatgaactcacgataaatccggcatcgtgggtaatctaccacttgtttgatttgaagttggtattctggcatagtgaacctcctagttttttatgcagacaagtagttcgctgaaaaatgttgacttgaataactgatgggggtatactcatatttgtatgagctgcaaataagcagtttgtgcattgctggtttccgcagttttagcattgataccttataatataggctaaaagcgataaagaaacagtatcagggatgttcttcatggctctacaatgtgccagtccttttcatggaaaatttatccaatttttgacattttggagctgacacactttttcacaaaaaaatatgcctacaaacaactacaatttttatacaacttttcgagtgaagcggacggtcaaataggacacaggacgaatgataaatagtttcaaaaacccagcaattatgcggattttgcgcactacggagcggcatggggcgggatggagagagcaaaattttattcccgacaatgaaacctttggactaaaaagttcgaaagtttgctgtgtttgcaggaatttctgcatgattatgatacagaaaagctgggctgtatgccaacgtgtgccaagcgtatgccaatccgtgtcgaagtcggcagaatgccccaaaaatcacacatttgcaaaagttttaccgccgcatcagagtaatctggtgcggcggtttttgtgtttataactgattttgggtgccgaagagtaatacgggaaagcgggaaatccccatgctgacagaagtgagggacacgctgctggcgctgtatgaaagaagaaatgatttcaatgcagataatcagattgtcattgatggctatacgaatttcgcctttcgtgatctgtatggtcgcgtttactcgaatcatcgaatcaaccgtcagcttaaaagaattacggcgaaatacaatcaggaggaacacgccgaggcagaacaagaagactgagaggaaaatcccattcccccgatcatatgttgcggcatacgttctgtacgaggatgattctgggcggaatagacttgaaaacagttcagattatcatggggcacgcagatgccgaaacaactatgcgcgtttatgcaaacgtgaccaaagcgcaagcccagaatgagatgatgcgaatggagggaaagatgaagctgaagtagaattaagtggacttttgaatgaagaaaaagtggatatgggaaatgcgaaagtggatattgagaatgaaaaagtggacattgaaagcgtgctttctgagaaaggcagtaatttctcagtaaaaacgacggttcatattcatagactcttttgtgaatgctatcctaatagttggccacaggagatgcgggaggtttgacggttacgttataatttgaaaaatacgattgacatacgagataaacagggctatgcttgtattgcaaaaaagcaagctcttgacagtgcataaggaggaattatcatggcatcactttttccaagagaggaacacgccgaagcactgttccacagaattctgagcaatccgggtgcagagcagcagttgtacgaaaccttctgcatggagcaggagaatgcatcgtttgaggatggcggcggtgcagagtgcagctttacgaaagcgcttttgcaggcttacgagaaccgcgatatttccgcgctgacgattgcgctatgcaataacacgatgttcgatctgctgcgcacagcctatcttattccgtatcgctttcatggcaaaaacggcgggaatcccagactgctgaccgatgcgaatggtgaggtgcgcgaggaataccgcaatgccgtctcggcacgagagctgcgcaagttccacgatatttaccgtcagcacctgtctgtaccgcgtgcggcgctctacctggccgatggcagtcatctgcgccacaagtacaccaaggacatgcaggtgcgggagatgtattcgccgtcccgccgcggcgtgctgacgctgtacgcgctgccggatacggtcgagcagggtctgaccgaagcacaggcgtacaacatcgtctgggacgcattcaatgaaatccagcagagatgtccgaccgcgatggtattctacggtcaggacaccggctacaagttgcagaaaagccacgatgaactgggcgttctgctgccgcttaaggagtttgaacataacatcctggaccatctcgagcaggtggacggtattgtgctgcgctgtcgtgaggagatgatccatcaggctggcaaggactcgctgccgctgtaaaaagcataacaaaaccgctgctatgaggaaaactcacagcagcggttttggcttgtctgcagaaaatcaggtgcagtaacggaacatcttatccgtcataatgcgggcgaagatcagtccgagcggaagcgcgagaatgatcaatgtggcagacgcgaaccacgaagcggaaatgctcaggttcatcataccgagattgtaaattgcgcggtagagatacaggccgggcaccataatcacaatagacggcactgtaatcgcgatgcgcggaaaaccggagtgctttttgtacgcagaagccagcagtccggcggtcatggccgcgaaaaatgcggcagccgcaggcggcaaagatgcaaggtcaaccagctccagacgcagcgtgttggatattgcgccgataaccgcggcggacatcgccagtggtaccgggctgttgaacatgatcgaaaagccgaacacaccgcagaagctggtgagcaggcggaatacgatatactgcagcatgctgaggttcagcggcagaaaatctaccggtttgaggtgcagcgcgagcgccatcagccatgcggccatcgtggcaatcaatacgatcattaccgcgtagctgagccgttcgagacctgaccgcatatccagcttggccatgtcgatgccgctggtgatgaacggaaatccgggaatgatgaacagcatggagcagatgtagccggcttcgtgctggacattgatgccgcaggtcatctcggcaatcttgagacagcccgcgtacaccagacaggctgctgcgaccgaaacagtcgtgcagagcacaagcgtcagatggtgcttggacagcttgcagcgcacggcgttgccgatacccgcgccaaagaatgcgagtatcatctcgacccagccgccgccgagcagaaacgtaaatgcaccgcaggcgagggcagccgccaggccgagcatcagtggcgaatacagtccgtgcacctgctcgatttcgtcaaggtgggtgtgcagctgctcgccggtcatacgggagcagatgtcggcaaactcagcgacgaaatgctcgagtcggttgagctttgaggtgttgacgcctgtgctggtcagcgtgagcgtttgcgaaaatgcctgttcaccgtcaaagcaggtgtattcgatcgaggtcaggccaatgtcggctgcacagaccagccccagctcctccgcgagcgtgttcatcgaactgcggacacgccatgcaccggtgccgcatgagagcagcatcaagccggtgcggccgatgacggaggccttctcgcgcaagggcgcggcagagatcggtagagtagcatcatgtgatgtgtaatcgtgccacgcaatgtgcatgtggttggggcgaaaagcagtttgcggcatagtaatacacttccttatatggctgtattgtagtcgttctgtgcagtaaagtcaatagatgaatgtagaaaacgtctgttcaattatttgtaaaagtaaattcctgttgggtgtggaatttagccttacaaacttattcgctgttctcctatggaagtggaattataaaagaaccgtttaggtcaaaagtactgcaccatcctataaaggctacggatggattccatgaccgtatggaatgcgatgttcgtcagaaaagagcgtgactgattgaaagtgatccgtaactctggtataatttgaatactaatgacagcccacaacaaggaggctaaggtatgggaatatatttgaacccgagcagcattggattcaaaagaagtctgaattcagaaatttatgtcgataagaccggattgattgaaaagacgaatgccctgctcgatacagaacagaaattcatttgtgtcagccgtccgcgccgttttggcaagtcgatggcggtgaatatgctgtctgcatactatgcctgcggcgaggattcttctgcgctgtttgacggcctgacgatcagccatacagcatctgaatcagtacaatgtaatcaaagtcaacatgcaggattttctgagcatgacgcacagcatggatgaaatgctgacaatgctgcaaaaataccttgttctggagttaacacgttccttccctaacacagcattctttgataaaaataatcttattcaaatgatgcgagatatctatgctgagacaaatcgctcctttattgtcctcattgatgaatgggactgcctgttccgggaatatcagcatgataccgctgcacagaagcagtatctcgactttctgcggtcatggctcaaggataaagattatgtggcgctagcctatatgaccggcattttgctgatcaaaaaatacggcacgcactcggcgctcaatatgttcaccgaatattctatgaccgacccaggcgaactggcaccgttcttcggtttcaccgaacaggaagtacagctgctctgtgaaaaatacgatatgaattttgatgaggcacgggcatggtatgacggctatgagttgatttctcatcggcggacgggcgatattcattacgccatgtacagtccgaaatccgtagttgaagctatgctccgtcataaattcggcacttactggaaccagactgaaacctatgaggcattaaaggtctatattcagatggacatggatggtctgaaggatgcagtcgtagaaatgctggcaggcgcttccgtgcgcatcaatacaggcacattcgccaatgacatgacgacatttgctaccaaggacgatgtgctgactctgctcgtacatctgggctatctgacctacgacagcgaaaacgagaccgtaactattcccaataaagaggtctcgcaggagtatgtcaacgccatcagtacaatggactggcatggtgtcatacagtctgttcaggcatcacgagagctgctttcgtcgctatgggccggaaatgcagacgcagttgccaaagggattgaccgtgcacacgaggatatttccattctgcaatacaataatgagaacgcgctcagctgtacgattaaccttgcgttctattttgcgcgcgagtattacaccatcgtgcgtgagctgccgacaggcaaggggtttgctgatatctgtttcattccccgaaagctgcatctggataaaccggcggcaataatcgagctgaaatgggataaaagcgcgactggcgctctgactcagatcaaggagaagcactataccgctgctctgcacgactatgccggtgatttgcttcttgtgggtatcaactataacagggatacaaaaaagcacgaatgtgtaattgaaaaagtgcagaaaacgtcgtaaccgctacaggatgttgttaaagaggtctgtttttatactctcgtattcttgatgcctgtaaacgggatccgtctattcggtcgtcattatctggtcgcacatttgtaaccgttaaccgaagaatttgtctatcttaagcgccaataaaaaatgggttctgtaagcgttgatgccacagaacccattttttattgtgtagatgagtaattatacagaaaaaacaggacgaatatcttgcttaatacctgtcaaagattcctgttcttttgcccaagtgacacgagtaacttcctctacaaatgcctttactttaggcgtagcagaataatgccggatgccgaattgctggcagatgtcgaacaacaggtcagtataagccatgtcgtcttggaaaggcatagcaaagtatccgccagcctgctctgctaattcatcaattatatacatggaatcattttgcttcatcttcgttgacctcctccacaagatactttgagaaaagttgccaagctgcctcatcagcaagcataaagcgcttcggactaccgttggttatgatcggaatacgcatagcaccaaagtcttctgcgtaatgcttcgcaagttcatcggtttatgcatcgaacacaacatcacctcggcaaccgttgtctatggaatacttgatgccaaatgcaattagtgcagcgccgataccgctgtatttgcgctcggatttttcggtgaggcctggattgctatgcggagcgctttctgcatacaagacatagacatatggtagacaacaataatgtctgtcgttttaacttttttattgataccgcgtccagtcggggacgctcgtcagcttcgtccagctttcgccgacctcgccctgacggtcgaagtcatggctgttcgtggcctcctgtacggcgagatagtgccagtcggacggcttgttgtccgaccatgttaccatgctgtccagcaggtcgcttttgctctgcggcatacggcagagtacgcggttgatcatggtcatagcctcagcgcgggtgatgcgggcgtcggggcggaacgtgccgtccggatagcccgaaatccagccgaacgccgccgctctctcgatctcgttttccgcccagtgaccggaaatatcggagaagctgccgctgttctcgaccgttctggtgctgaagcgcgcacagatcgccgcaaactccgcacgggtgatcgaggcattggggtcaaagcggtccgcacggcggcccttgacgataccgagcttcgccatcgtggaaaccgccttgttgtgccactggccgtccgaaacatcggaaaaaccgttgtcggcggtcagatttccgtcgcggatgtctgctttgagcagtctaaagaagatcgtcgctgtttccgcacggctgatattgccctccgggtgtacctttccgtccggatagccgatgacataggcgaaatggtcatcgccgttgagcttgtccggcacgccggttgcctcccagcctgcgtagaccgtcttgtcgctgttcatcgtcacggtcgtgatcttctgcgtcagcgccttgtcggcataccagccggtaaaggtatagctctcgcgtgtcggggtcttatcgagcgtcaccttcgtgccggaagaacagcgctcatccttgtaagccgtgccgccgttcgactcatagtgcagcgtatagcgggtcgaatgatgggaggaggagctgccgccgccggtgctgctgaaccggtagacataggtcacatctccggtaatgccgttcggggcggtgttcggcgtctgctcccagccgccgggagccttgtatccggtgtccggagtcatacccgtcggcacgtcagcctcagacagcgttccgagaccgttgcgcagcttgacggtaacggtcttgtccacgctcgtgccgtccgaccatttgccgttctgcaccttgaaggtcacggtcttcgtgtcgagcctcgtccagcggccgtaaagaaccgtatccgtattcagaaccgtaccatccacaaacggctgcgtgcattcctcatccgtgtaccaaccatcaaaggtatatccctggtgcgaattctgctgtgctttcgccgtatatgctctgccggtacggatataatcattcgcagggggtgctacatctgtggggttatccatgctgatccatttatagcggatgcagatcgggccggtgatggtgatgacgaccttctcgccgtaattcgcgcccctgatctcgcctgcgtgcgcctgcggcggaatcggcagaatgttcagagaggtctggatggcgtcgtcgttgtcgtcgtcgtcgatgtccgcaaggttctgttcggtatggcggtagggcgtcgacttgaactgcggcgttccgttgctgtcatagccggtgaagtggtaataatccaccgacgcgaccttggcggacaggatatggtggacgtgtttcagctggctccagttgatctcgccatcgttgaagctgttcacacgaatgctcagttcctcggctgtgccctcgccgacattggcgtcgatttgggttatcagctctttgagcgcctcgttgatgttgttcacctgactgagtcccttgaaatagtccgcgccgtttgttgtagacgcattgccgcagatggacgccatggtggagttgaagttgtcccgctgcttgtcgacgtcgtgcagaggattactgctttccaggttcagctggtggaaatcgcccagaccgaaaatggtcgcgtcataggtttccttgagcatgttcgccgccgctttcgccgcctccgggcgcagcttctgataagtgccgttgttctggtaggggagcgagctggcggcgatgcagacgatcagatttcgatcctcaccggctgcctcaccggttgacttgtgcgccttggcgatcgaggcaagccgctccgtgatagtcagaccggcgtccatgcgcgccgcaccggcgtaccacggcaccattgtattggcgtcgatgacctgcttggcgttgtcggccgacaggaacacattgtcatagttatctgtcagatagttcgacggcagctgcggcagggacgcgtcatctttaccgtcgcattccgtccatttgctctgcgaatgaaacaagccgtctttggtataatagccggtgttcaggctggcattattgtccgacagcgtgccggggtagagcgcggcatcatagctgtcgccgatgccggggttgttgatgcggccgtagcccgcgatcgcaatgcggtgctcgccgccgggggtggtcggcgtcggcagctcgtttagcaggctttccatggcgctcaggatttccgcgcgctcgccgccgggattggccgagtcgtgcgtattcatgaattgtgactgctcgatcagaaaaatgatgtcgcagggcttgaccgtccgggtcttgttggccggatcggtcatgtaagcctcgatctgcgcggtgatctgtccggtctccgcgtgctgcacggtggccgtgacggtcgccgccgcgttttctgcgttttctaccgcctgcgccggtgccgcggagcgatataattgagaaagagcagtcactgtagtggtggctgcttttgctatattgaagactgcatgaaaatatgctatgataaaattggtagattaggatttagaggatgtgaatgagcagcatgaagcaaacaaaagaaggagttaatttgaaaaaactccttaggctgaagaatacaggcagtatctttgtgattgctgggcttttgatcatttttgtaatagcgttgtacacatttattctgcaaagttcttacactaagaccgcccttgaaacagaaatcacacgtgacacagcgagtgcagatgcagtacacaaacttgtggatggaagaatcggcaaagaagattttgatcaaatcaacgatcaatctgatgaaaagaatccattatataaggatatttcttcatatttcaatgaagtcagaacactgaattctactcgatatatttacaccgctaaaaaaaatgaagaaggaaaactcgtttatgtggtagacggtttggacccggatgcggatgatgtaagacaccccggagattatattgaggacgaaatggttccgtatattaatagggctatttctggagagaatgtgtactctcaggatatcattgatacaacatgggggccgatttttacggcttgctatcctgtaaccgcaaatcatgatggaacaggagaaatcattggcgcattttgcattgaaatggatatgcaatcagcttatggaatggttgaaaagacgaatcatatttccatcatctgcggtttagtcgcaggagctgtattgcttttaatttgtctatatacctattatgtttaccagaaaagcaaggtagaagagcaaaaacaaaaacaattattaatgaacgccgctgaggaagcagatgctgccaacaaagcaaaatctgcgtttttgcttagtatgagccatgacatcagaacgccgatgaatgccattatcggatttacaaacattgcgcttcaccagaacatggtttcagatattcatgatagcttgaagaaagttcaacaaagttcgaatcatcttctctctttgttgaatgacgttctggattttagtcgcattgaaagcggaaaagttactatttcgcccgagccagtggacattactcaattgacagataacgtccaggcgattatgaatggacttctttacaatcgagatcttcagtttgaagtacatcgagaaaacctaaagaacccatatgtccttgcggatgttgtgcgtatccgagaagttttggtgaatcttcttggcaatgctgtcaaattcacaaaggacggcggagcgattactttggatatcagcagttaccccggagcggatgagaaacatatcataattcgttatgttgttcgagataacggtattggcatgagcgaagagttccagaaaaaattattcgatccgttttcacaagaagatgatgccaatgccagaacccaatataagggaaccggtcttggtatggccatcacaaaaaaatatgtggatatgatgggcggttcgattgctgttgagagcaaaaaaggtgtaggtgctacattcacagtggagatcccgctggagttgccagaacaggttattccatcagaacaaaaacaacatctgcatagagatttgacgggtattcatgttcttatggctgaggataatgatctaaatgctgaacttgctacgataatgctggaagatactggtatgatcgtaacacgcgcatcagacggaaaagaagttgtggatttgtttaaaaataatccacgaggcacatacgatcttattttgatggatattatgatgccaaacatggatggacaccaagcagcaaaagccattcgagccttgggtatagagcggtccgatgcagttacgattccaattatagctttgtctgcaaatgcttttatagatgatattcaggaatccctggattcaggcatgaatgaccatatttccaagccgattaacatagaggaattaatcgatacgatcactaaatacattaaacgcgattaggaaaacaaagaagttaattctgatgaaaagtttgcacaagtatgcggaatatttgctcgataatgatttacgcagcatttgcaggttatattgatactttagcataattgagctgaaataatatcaaggaggttgatggtatgaatatgattagaccggtatcggatttgcgaaataattttgcggacatttctaagacggtgcgcgaaacggctcagcctgtcttttaacccccaaatgggtatggtgatatggtcgttttgagcatggaagcgtttaaaaacctgcaatttgaaagtgaggtttacttcaagctgcaagaggccgagcgagaagcagagctgacagatcagcgatattcctccaaagatgtattgaaagcgatgaaagtcgctattggaggggagcagggtgtataagctggagtatctgcttgttgcccagagagatatggttgagattgtgcgctatatcagtgggaagttacaaaaacctgatgcggcagattgtttggtgatggagctggtgaacgttgcggaaagagtaatcacattttcgtatgcgcttccggcgtatcaaccaattcgcctgttgaagcgtgagtatcgaaaaatcttagttcagaattttttgatgttttactgggtggacgaagaaaagaagctggtgacagtcgctcgtgtaatgtatgctaaacgagatattggcagattgctggagtgatgaaaggtcgaatggctaagacgattaaggaaattgcggataactgtggagtgcttgaacagactgtacgcggttggtgtaggcgaaaccatgttgcgaaagaccaaaaaacttgatatagtatctgtcatacgggaagcggtttttgcaatattgagcgaatgggttcagttgaaatttcaagtagcagagcgccgaaaaagtggtataatgaataaataaaaggaagacagatgcgaacaaagcgtgagtgcaggcggtactgcgctgtgtatgccgcgtatgccaaagcatatgccagcaagtggattgtaaacaacaaggaatcgcagacttttaatcgaggccgatttaaccgctgttgagcgaccgcagagggtcaacaggggcttgcagacctttgtccgttcaggtcataatttcccgacaatacaattacttggttactgtatggtgtatattttcttgtgatagtagtgctgcttattgctcctaagatgaagaagtgaggaacttcaagtttgtcaacttgctctttgagagaggaaaaatccttttctcaaagggctttttctatttatacggatattcgcaaactgcaagataaagctaaaacttcatatactctaagcacaaggaggttgaggcttgactatgaacaatagtttagcaaaagtacacccggagcttgtttcggagtggccggagaagaatttatcgcttatgcctgtaacattacgttcggttcaattaaaaaatgaaatccagcagaggtgtccgaccgcgatggtattctacggtcaggacaccggctgcaagctgcaggaaaatcacgatgaactgggcgttctgctgccgcttgaggagtttgagcataatatcctgcaccatctcgagcaggtggatggcattgtgctgcgctgtcgcgaggaaatgatccatcaggcaggcaaggactcgctgccgctgtaaaacgaataacaaaaccgctgctatgaggaaaaactcacagcagcggttttggcttgtctgcagaaaatcaggtgcagtaacggaacatcttatccgtcataatgcgggcgaagatcagtccgagcgggagcgcgagaatgatcaatgtggcagatgcgaaccacgaagcggaaatgctcaggttcatcgtaccgagattgtaaattgcgcggtagagatacagaccgtgcacctgctcgatctcgtcaagatgggtgtgcacctgctcgcccgtcatgcgggagcagctgtcggcaaactcagcgacgaactgctcgagtcggttgcgttttgaggtgctggtcagcgtaagcgtttgcgaaaacgcctgctccgatgttccatctgacaacatcgaagcaggcgtttaaaaaggggagtcagcgggtagccttcaggcgtgccatagcacgggccagagccgctttggagagatgatattcacgaatactctgcttctggcgcagccgttcttccgcgcgctctttggcgcgttcggcgcgcgcacggtcgatttcgtcaggacgttcggcgctggataccagaagaatgcagtagtccggcataatttctgcgaagccgtcgctgacaacgacctcgtgcggtgtgccgtctgtctggaaccgcaccgtacccggacggagtgcggtaacgaccggctcatgtcccggctgcacgccgtattcaccgtcgagtgcaggcatagtcaaattggttgccggtccggtgtaaaactgccggtccggcgtgatgatctccagatagaaggtgttctccatcagagtgcccccatatccttggcctttttgtggacctcgtctaccgtgccgaccatggagaaggcagcctccggatactggtcgagttcaccgccgagcagcgcttcaaagccgctgatggtgtcctcaagcgttacatagcgcccttccagaccggtaaactgctcggcaaccgagaacggctgcgagaaatactgctgcatgcggcgggcacgatcgacaatgcggcggtcgtctgcaccaagctcctccataccgaggatggcgatgatgtcctgcagttcgcggtaacgctgcagcagctcctgtgcgccgcgtgcgaccttgtaatgacgctcaccgacaatatccggctcgaggatacgcgaggtggaatccagcgggtcaacggcaggatagatgccctgctcgacaatcttacgggagagaacggtcttggcgtccaggtgggtaaacgtggtcgccggagccgggtcggtcaggtcatccgccggaacatagaccgcctgcacggaggtgattgcgccgtccttggtggaggcgatacgctcctgcagagcaccgacctcatcagccagcgtcggctggtagccgaccgccgagggcatgcggcccatcagtgcggaaatctccgagcctgcctgtacatagcggaaaatattgtcgataaacagcagcacgttctgttttttcacatcgcggaagtattctgccatggtcagaccagtcagtgcaacgcgcatacgcgctccgggcggttcgttcatctgtccgaacacgagcgcggtcttgctcagtacgccggattccgccatctcgcgccacagatcgttgccctctcgcgtgcgttcgccgacaccggtgaagatggagtagccgccgtgctcggtggcgatgttgtggatcagctcctgaatgagcacggtcttgccgacaccggcgccgccgaacagaccaatcttgccgcccttggcatacggcgcgagcaggtcgatgaccttgatgccggtctcgagaatctcggtcgtcgggttctgctgtgcaaaatccggcggcgcacggtggatggaccacttttccggtgcgtttacatcgcccttttcgtcgatcggctgaccgagcacgttgaacatgcgtccaagggtcgcttcaccgaccggcgcctcaatggtgtggccggtggacagcacctcgtcgccgcggccgatgccctcactcggggagagcatgatgcagcgcacggtgtcgccgccgatgtgctgtgcgacctccatcatgcgcggctgtccgtccggtgcaacggtaagtgcttcatttatctcaggcaggctgccgccgtcaaaagcaacgtccacaaccggacctgttacctgtaccacggtacctttgcgtttcatagtaatttcctcactttctatgcgcgtctgccgtctgcgagaaagcggacggtccgcgtcggaatcggacggcggggctgcggtgtttccgcggcgctgccctgtgtgccgccgacgatctcggtgatctcctgcgtgatggcggactgccgtgcgcggttgtagtgcagtgacagcgatttgagcatatcgcgtgcgttgtcggtcgcggagtccattgctgtcatgcgggcattctgctcggcacagaaggactcgaccagcgcaccgaacagctcacccttgacatagccgggcacgagatgctcgagtacacggtctgccgagggtacatactgcaccatttgatgataggggccgtgttcactcgggcgcggctcccatgggaacgcgtcaatgtcgagcggcagcagcttctgcacgcgcggctcaagccgcataggcgttaccatttcggtgtaaacaacgtacacgtcgtccagctgaccttcgcggaacagacggatgaaaatatccgcaatgtcccgcgcacgggcaatcgtcgggtcctgcacggtgaacatgaactcgccgtctacgcgaatgtcgcgttcggcgaagtacgcgcggcccatctgaccgatgaggaacagcgtgggatcgtcctcctgcgcaagatgcttctcggccagacgcagcacattgtgattgtacgcaccggccagtcccttgtcgcccgtgataacaatgtagccggacttgcggtgcttgacctcgggccgcttgtcgaaataaatatgctcgatttcaggggaatggtgcagaatatcggcaatcgtggagctgatcttgagaaaatacggctgcacattgttcagctgctgccttgccttgcgcagcttggaggacgagatcagatacatcgcgtttgtgatcttgagtgtttgctgcacactgtcaatgcgggtgcggatctcctttatgcctgccatgctgcactcacctgatctttataggttttcagggcttcccggatctgttcggcagccgtgccggtcagggtaccggtggactgaatttctgtcagcagggaatcgggcagactgtcggcaaatttctgcacaaaatcgcgtacccggtcgagcggaacatcgctcagcagaccgttggtagccacatacaggataaccgcctgccgccataccggcatcgggtggcacagcggctgcttgaggatttccatcaggcgtttgccgtgctcgagggcctgctgagtgtccttgtccagatccgagctgaactgggtgaatacctccagctcgcggaagcgggcaagatcgatacgcagcgtaccggcggttttcttgatggccttggtctgtgccgcaccgccgacacgcgataccgacaggccaacgttgatcgccggacgctgaccggcaaagaacaggtcgttttccagataaatttgaccgtccgtgatggaaatgacgttggtcggaatgtaggcggaaacatcgcctgccagcgtttcgataatgggaagcgcggtcatcgagccgccgccgtactccggcgtcaggcggcaggcacgctcgagcagacgggaatgcaggtagaatacgtcgcccggatacgcctcacggccgggcgagcggcgcagcagcagcgacagcgtgcggtaagcgaccgcgtgcttggacagatcatcatacacgatgagcacatcgcggccctgactcatgaaatactcgccgatagcggcgccggcatacggcgcgatatactgctgcggcgcaccgtctgctgcggtggcggaaacaatgatgctgtaatcgagtgcgccgtatttctcgagcgtgccgcgcaggcgcgccactgtggatgccttctggccgatggcaacgtaaatgcagatcatatcctgccccttctggttcaggatggtgtcgatggcaatggacgttttgccggtctggcggtcgccgatgatcagctcgcgctgaccgcgtccgatcggcaccatcgagtcaatggcaaggatgccggtctgcatcggctggtttaccggctcacgcgataccacacccgaagcctctcgctcgatcggacggcgctcggtcgtttcaatcggtccaaggccatcaatcggttcaccgagggcgttgaccgtgcggccgatcatcgcatcaccgaccggaacgtcagccgcacgtccggtgcggctgaccgccgagccttcatgcaggccgtcctcgctgccgagcagtaccacgccgacgctgtcgcgtttaaggtcgagcacgatgccgtgcacaccggtgtcaaactgcaccagttcgccgtagacggcgcggctcagtccgtaaacggtggcaatgccgtcaccgacctcgatgaccgtgccggtttcgtcgcagcgcgtgcggttgtcatattgttcaatctcctcgcggagaatagataaaatctcatctgaatggttcaatggttttcacccctttacaggtcatgcgccagtgcgcgaagctgtccgcgcacgcttttatcgtaggttacgccgtcgatttcggcagtaaagccgccgagcagcgtgtcgtcctgcacgatttcaaacgtaaccgcacaataactgtgtcgtgcgcacagcagtttggcaagcgaacgcagcgattcatcatccggttcgcgggcacagcgaaatacgcacaggccctcgccgctgtcgcgcagctcaagcagacgaaactgccggacgatctccggcaggagcgcaaagcggtttttgtccgccagcagcagatagaagtgctttagctcgcccatcgcatcaaaatcgggcaggcgggacagcacagcctttttctcccgcgcggaaacggcaggagagcacagtgcatcccataacggcgcacaatcggtcagataatcggcggtgtgctgcagatcgctcagcgtgcagccggtatggcgcagtgcaccggcatactgtacggcggtcgagctcatcgtgcggcctccgtttcttcacgcagaaaatcgtcgatcatggcgcggtcggtgtcgctgttcagcttctgccgggacaccttggcggtggtcagcagaacgagagcggtaatctcctttttcgcctcacggagcatctgcgtccgctcggattcccgacggcgggcagcctgctcatcgagccgctgcacagcggtctgcgcctctgcgacaagacgatcgtactcctgctgaccgcgtgcacgggcgtcctcgatgatctgtgcggcctcctgctttgcggaagcaagctgcgcggcgtgcgcggtctgctgctgctcggcctcggcgagacgcttgtccgcctgatcgagcgtgtccgacacctgctgtgcacggtcatcgagcatttgggtaatggggccgaacaggaatttcttcatcagcacgaacaggatgagcagatcaacaaacacccagataatctgcgaatttagattgaggatcattcgatctcaccccgatcaattcatgaaaataagcaggataccgatcagaaaaccgtagatggcggttgcctcggccagtgcacagccgaggatcaggtttttgctgatctggccggaggcctccggctgacgcgcaatggcttccgaagatttcgcggttgcatagccgataccaagaccggcaccgatgccggtcataactgcaatagctgcaccaatagcaatactcattttttgtggtcctttctcagataaaacagtgcttactcaagcgattccgacaggaaaagtgttgtcaggaatacaaatacgatcgcctgtatcatgccgtcgaatacatcgaaatacaggctcagtggaatggggacaacgaccggaacggccattttgaccagctccatgatgacgaatccggcgaaaatgttgccgaacagtcgcatgcagagtgacaagggccgaatgccgatctccataatgttgagcggcgtaacgaccgaaaccggttcgctgaactttttcagtccgccgcgcagaccgtggaaccggaactgcgagccgtagatcagcagggcgctcatgatcgccagaccggcggtgacgttcaggtctttggtcggcggcgtaacgccgaacagaccggccatgttcgccagcgcaagatacaggcctaccgtgccgaggtacggagcgaaggtgcgccagtatttgtcgcccagtgtgtcgcggcagaaattgttgatgaagcccaccagcatttctgcggcgatctgctttcgcccgggacgcttgcgcagtccgtgcgtcagccagatggcaagcagggtcagcacaactatgatcgcccaacttaccacagcggattccggaaccggtattccgccaaacagcggaatctcgaacgcaatatgggtttgcagttcggcattcaattccgctttgatttcacccaaagggcatcacctcgtttgtctataagttggtttacgcgcttattgtaaaaacctgtcggagtttacgcaagcttatgaaactaaaaaaaattaacccgcgcaatttgacagatttgcataaatctgcagaggggatttgatgaatgttgaccagtgtgttatgatatgaagtatcttcttaaaaaggagtggatgaatttgataaatgcacgttcttccggctcactgcaccggcaggtgcgccggatgctgatcctgtgcattgcggtggtggtgctgctgtccacgtcggtcggtttgggcatcagcctgtatcaggaggtgcggacgcgcgaccagctgctgtccaatgcggcgcagatggcggcagatgcgccgctgctgaccgaggatattcgggcagataacgcacagcagtatttggcgcggaccgtacagcgtgtatctgaagtagatatgctcggcgtgtatgatattaagggcaagccgacagtgttttacgatctcgtgtccggtgcaggcgacgcatctttgctgcccgaactgaaagctgatacggtcagccgcctgtgcagcgaggaaaagccagtgctctcgaacgatgagatgccggacggcgcggatcgctgtgcctatgctgtcatgcgtgatgaaaacgggcaggcgaccggtatcgtcatggcagggctgtatctgcgctcctaccatcggacggtgctgcgtgtgctgctgtcgtatctgctcatcacgctgttcgcgcttggcatcggcagtctgctcagcgtgcggttttccgagcgggtcaagcgggaactgctgggctatgagccggacgcgttccgtcagctgtttctgcagcgcatggatattctggatgcattggatgagggtctgatggcgatcgacgaacacagcatgatcacctatatgaaccgtgcggcagcggatatcctcaaaatcaaggtgaaggatgcaatcggtcagccgttaaagacggtctatccgcgctcgacgatggcgcgcgtgctgcagaccggcaaaagtgaatacaacatcggtctggagtccatcaagcatgtttcggtcatttccgaccgtatgccgctctggcgggacggcaaggtggagggtgttatcgctattttccgcaaccggaccgaggtcacgcggctggcgcaggatttgaccggcgtgcagcacatagtcggtgcgctgcgggcgtatacgcatgagtttaccaacaagctgcatgtgatcctcggtctgctgcagctgggcgaggacaagcaggcggaggagtatgtgctgcatttgacgcagacgcgtgcgcactcgatcggctatatttccgagcgtattcgggagccgtcggttgcggcgctgctgatcggcaaggtatatcgtgcggcggagctgggtatccggtttgtgctcgacccggcgagtgagctgcatggagaaggacggtatcttccggcgagcagtctgatcaccattcttggaaacctgattgagaatgcgttcgactcactgcggaacgcaccggagaccgcacagaaggaagtgacggtcagcatccgcgagggcgagcacggtatgctcatcagtgtggatgacagcggtgcaggcattgctgccgataagctggaccgcattttcgagcgcggcttttccaccaaaggagagggcagaggcaccggtctgtcactcgtcaaggagaccgtggacgcgttccacgggacgattcgcgtcgagtccgagccgggaattggcagctcgttcatcattacggttgcggaatccgcaaacagacagcagtagggaggaaatccgatgtacacaacagttattattgaggacgacccgatgatcacacggctcaaccgccggtatatcgagcaggacagccggtttgccgtcgtgcagacgttttcggcggcgcatccggcgctgttctggctgcggcgcaacccgatcgacctgattattttagacgtttacatgccgcagatgagcggcaccgagctgctgctgcagcttcgtgcggaaggcgtggatgcggatgtcatcatggtcacatctgcgaatgacgcaaaaacggttaacgatgccgtgcgattgggagcggtggattatctggtcaagccgttcgcgtatgagcggttccggcaggcgcttgatgtgttctgccgccggcgagaaagcgtgcagcgcgacagcttcagtcaggatgtgcttgaccatacgctgtttcaggcggctgcgccgacaccgcctgtcacgccgccgaagggtctgcagagccagacgctttcgcgcattgaggcatatctgcgcgccgcgccggagacacggcataccagcgatgagatcgcatcgcatgtcggtctgtcggtcgtgaccgtgcggcggtatatgaattatctggcagagcagcagatcattggcagtgagatggattaccgtaccggcggacggccttgcctggtgtattttctgagaaagtaacgattttctcaaaacgaaggatttgcatagctcaagcgtcaagaaaaatgggttctgtgagcattgacgccgcagaacatcgaatttgaacaatcgacccgtcgagaaatcggcgggtcttttttgcccatcggagatgcggcgcggtgtgttcctttcgcagccttgcagctgcacagcgtctcacgccggtatcccgtctcaatctgttttacaggcacattcgcgcaaaagcgctccgaatacggcgaacagtctgtgttcctgcctgttttgacagaaaacaggcgaaattccttgaaataccgcctgtgaagtgctatgctattcttatataatgccgttttgcggcgagaaatgaggagaaagaagggcagtctgtcggggagaggcggctgtcacgggtaaggagaattggttgatgaaaacaaaaaagcggaagcgcggtctgtccttcctgctcgcggtactggtaacagcggcatgtctgctgaccggctgcggcacacaaaagagcgaagcgcaggaggacgcggaaaccattcaggtctatctgtggaacaccacgctgtacgaaaaatatgccccctatatccagtcgcagctgccggatgtgaatattgagttcattgtcggcaataacgatctggatttttacaaatttctgaacgagaacggcggcctgccggacattatcacctgctgccgcttctcgctgcatgacgctgcgccgctgaaggacagtctgatgaacctcgccacgaccaacgaggcgggcgcggtctacaacacctacctcaacagcttcaaaaacgaggacggcagcgtaaactggctgccggtctgcgcggacgcgcacggctttgtggtcaaccgcagtctgttcgagaaatacggtattccgctgcccaccgattacgacagctttgtttccgcttgtcaagcgtttgaaaagcgcggcatccgcggctttgatgcggactatttcttcgattacatctgcatggaaacgcttcagggactttctgtctccgagctttcctcggcggaaggccgcaaatggcgcaccgcctacagcgacccggccagcaccgagaaagtcggtctggatgacaccgtttggccgaccgcattcaagaacctcgagcagttcatccacgataccggtctgaacgccgctgacctgacgctgacctacgatgacatcatggatcggatgcgcagcggcgagcttgctatgttcttcggcagctctgctaatgttaaaatcctgcaggatgagggcattgatacgaccttcctgccgttcttcggtcaggatgggcagcagtggctgatgaccaccccgtattttcaggttgcgctgagccgcaatctcgagcaggacagcaaccgccgagacaaggcgatgcaggtgctacgtgtcatgctctccgaggaagcacagaaccgcatcgtctatgacggacaggacattctgagctacagccagaacgtcagccttcgtctgaccgattatctggaggacgtgcgcccggtggtcgagcagaaccatatgtacattcgcatcgcctccaacgatttcttctcggtctccaaggatgtggtctcgcgcatgatcgcaggagaatatacggcagagcaggcgtatcaggcgttcaacgcgcagctgcttgcggatgagcctgccccggatacggctgtgctgaccttggacaagggctattcgaacgttttccatgcggacagcggcaatgcctccttctccgtaatggcgaacacgctgcgcggcgtgtatgacaccgatgtgctcattgctgcggcgaacagctttaccggcagcgtgctggcggcagactacaccgagaatatggctgcctctatgatcatgccgaacgatctgcgcgcgtatcagcgcacgatgaacggtgcggagctgaccgagaccgtccgcgcctttgtcgagggctgcgagggcggctttatgccgttcaaccgcggctctctgccggtggtcagcggcatcgccatcgaggtcaaggaggaaaacggcggctttacgctgaccgggatcacgcgggacggcaaaccgctccgcgaggacgagaccgtaaccgtaacctgtctggcgacggcgggcagcatggcgccgctgtttgcggacgagagccgtgccttcgagggcggcgacacgagagttcgggacacctggagcgcgtatgtctccagagggaatgccgtactggcggagccggaaaactatattacattgaggtaaacggaaatggcagataaaacacgcggaagcaaaataaaataccgcttcctgaaaaaatggcgccgccctgccgccgcactgttggctctggcggtgctgctcggcggcatctgctatcggtatttcttgtttatgtcgcagacggtctatcgggagagcacttcgcatctgtcggagatcctgcgtaaatccgacaatatgctgaaccatctggtcagccgaaaccagatgattctgcatctgtggggcggtttgctggaaaacgcctcgagcgaagaacagatccgttccagtctgaacgagatgcagaaggagaccggctgcgccgccctctacttcctcgcctcggacggtagctgcatgacgcaggacggcgaaaagagcagccttggctcgcagaccgatctggacgcgctgatttttgccggagatgacgtcgttgtgaatacggcgctgcccggcaagccgcagatgctcgtgtttgcctgcccggagatgagcggcacctaccgcggcttcgcctatgatgcgatcgccatcgcctactataatgatacggtgctgagcgcgatcgacaactccgccttcgagggcacgagccacaactatgttgtctatccggacgggcgcgttgtgctcgacagcgaggctgtcggtgagaacggcagcgaggaatcggtctataatttcctcgcggagctgcgcagcagctccaatctgtccgataaagcgttcgacgcgctgagtgacgatttcgcgcagggcagggacggaagcaagatgctgacgctgcatggaacccggtactatctggtctacgagaacacaggcatccaggactggatcatgctcagccttgtcccggtcagcgttgttaacgccagcatggatacgctgtggcaccggacggtcgagatcgtggtcgttatcgcgtgcctgcttatggtgctgcttatcacgctcatcgtgcacagaagccgtgacgcgctgcgtcggagagataccgagattctgtaccgggatgagctgttcacccggctctcacgcaacgtggatgacgttttcctcatgatggacgccgaaacctcccgcgtggactatgtcagcccgaacatcgagcggctgctgggcgtgccgctcgagcaggtgcagcaggacatccgagcactgcgggcgctgcacccgaaggattctcccgaccacgataagaacttcttcgcggggattcagtgcggcgagcagtgcgaatggaacgccgattatgcccatcagcagaccggtgagcgccgctggttccacgtcgtcgtcatgggcagcgaggtcgcaggccgaaccaagtacatccttgtgatgtctgaccgcacggctgaccggaagatcaatcaggcgctttccgaggcggttgcggccgccgaagccgccagccgcgccaagagcaccttcctgtccaatatgtcgcacgatatccgcacaccgatgaatgcgatcatcggctttaccacccttgcggtcagcaatatcgacaatcaggaacgggtgaaggactatctgaccaaaaccctctcctcgagccgccacctgctcgcgctcatcaacgatattctggatatgagccgcatcgagagcggcaagctccagctagaggaaaccgaggtcaacctccccgagatgctgcacgacatcaagaccatcgtcagcggacagatacacgccaagcagctcgagctttatatggatgcgcttgacgttaccgacgaggacgtttactgcgaccggacacggatggggcagatcctgctcaacctgctgtccaacgccatcaagttcacgccggcgggcggtacggtttccgtgcgtgtccggcagcttgccggaaccgtgcgcgactgtgcacagtacgagttccgtgtccgcgacaacggcatcggcatgagtccggagttcgcgcagaagatcttcgagccgtttgaacgcgagcgtacctccacggtcagccggatacagggaaccggcctcggcatggccatcactcggaacattgtcgagatgatgggcggcacgatcaaggtgcagaccgagaagaaccggggcaccgagtttatcatctgccttccgctgcgcgtgcagaccggaacccgtcgcgaggaaaagattgcggagcttgccggcctcaaggcgctggtggtggacgacgatttcaacacctgcgacagcgtggcaaagctgctgacccgtgtgggaatgcgtgcggagtggacgctctccggccgggaggctgtgctgcgtgcacggcagtccatcgagctgggcgacccctgccgggcctatatcatcgactggcggctgccggacatgaacggcatcgaggtcacgcgccagatacgcagcctgaacgatgacacacccatcatcatcctgactgcctacgactggtcggacatcgaagtggaggcaaaggcggcaggtgtgacggcgttctgctccaagccgatgttcctgtccgacctgcgcgacaccctgctgacagccatcggacataagcagacggaggtgcaggacatcctgcccgggaaaaacgccgacttccgcggacggcatatcctgctggtcgaggataacgagctgaaccgcgagatcgcggttgcaatcctgcacgagtacggtttcctggtcgataccgccgagaacggcgcggtcgcggtggaaaagatccgcacctcggacccgggccgctatgatctggtgctgatggatgtgcagatgccggtcatggacggctgcaccgccacccggcgcatccgtgcgctgaaggacccggcgcgcgccgccgtcccgatcgttgccatgacggctaacgtgttcgaggaggagcgaaagcgggcattcgattgcggcatgaacggctttttgtccaagccgatcgtgatcgaggagctgatcgacgccctgcgggaccttatacactgaccgcgccatgcggatatacaaaacccggagtaccggccgaaaacggctgacggtactccggttttttggacatgcagaggctgcagcgcggtaaaggataaaacaggggaataaatgccgctgcaccgcaatcttcgctttctttttgggtcgggaaatagtataattgtggtataggaaatggaatgaataaattttaccgaaggaggggcagaacatgaaaaagcgatcaagcattgctctgctgaccgcacttctcgctatagtgttcgcggcaggcattggcgtttacagcaactacatcggaatgcagatctatgaggaaagctcgaatcatctgcttgaaagctatgcgcaaatctccaagaccttcacgctgttcgtgcagcgaaactgggtcgtgctgagccagtgggacagcctgatgaagaatgcgcaggaggatacggatattgacagcatctggtctgatgcgcagaacaacaagctgttgtggcattacagcgacttctatctgttcaacgagagcacgcagtatctaacggtagatgggcgaaagggcagcgccgacagcatcgacggcgtttttttggagatgtacagcaagggcgagccaatcgtctccacctatacggcaacctacggtgtgccgaagatcgcgtttgcgatgccgatgagccgcagtctgacgctggacggcgtgacctacaccggtatcgcggtcagctatgacacggacgtggtcgatgatctggttgacggcagtatgtacggcggacagagcgactgctatgtggtgcgctcgaacggcgatatcgtgctggagcttgagccgcagaccgagctgtgcgagggaatgaccaacctgtacgacctgtccgaccatgttgactggaaatatggcagcatggacgatatcagggactgcatccagctcggcaagagcggaagcgcgcagttcacctgcgatggggtgagaaactatctggttgcgattccgaccgcgttttcggactggtcgctcgtcggcatcatccaggcggatgaggtggacggcgcgctgtatgacgtgcagaattcctcgctcatcctgctcggcgcactcagttttttcgctgtcatcatcgtggtgctggcgctgggcatggagagccggctgcgccttaagaatgaggaaatggagcggctgaacctcgagcgcgaaaagatgaagagcgaccgtttcctgcaaagcatgagccgcatcgtcgatcgctatatggtcgtcaatctggataccggacgctaccgctatcatgagctgcggagcagtgagccgctctatccgacctccggacagtattcggaaatggtcgaaatcatttctaaacgctatgtcgcgctgaccgaaacggaaaacgccaagctctcgcggctgcttacgccggactatctgcgcagcgtgctccggaaaccggatgacaatctcaaaatcgagtattgcagccggacggaaaacgcctatatggtgctgaccgtcctcccggtcgagtggcatgcggacggcacggtcgccgtggtcatgcaggttgtgcaggatatcgggcagaaggtcgagctggaaaacatggcaaacacggacagcctgaccggcctgttcaacgaacgctatttcagcagggtcctgaacatctgtgaggcgaaaaagctgccgttcgtgctgtattacctcgatctcgaccgctttaagccggtaaacgatacctacggtcacgccatgggcgaccggctgctcaaggagatcagcgcgcggctgctgcgctgcatccgcagccgggactatgccttccgcatcggcggcgatgagttcgcgctcatcgtcagcgctgatatggacgcggagcagcgcagccgcatggccgagcgcatccagaccatgctctctgcgcccatcgttatcgaagaaaaagtgctttcggtcggcgtcagctgcggctgcgcctgctatccggaggacggcgacgcttcgcaggtgcgcatcacggcggacagccgtatgtacgcggaaaagcagcaccatcacgaagacgaccggacggaggaacagtcatgaaacacaaaaccctgcggtgcaccgcagagacggtcgccctgctgctgaccgtggcaatgctggcgttcctcgttgccggactgcatcagcacgatccggacagggtgctttccacccttaataccggctggtatcagctgacggacggcgtgcggcgcgagattgcgctccccgtcacgcttccggctgagccggggcagacgcttaccctgtataacgacacgctgaccgcccgcgatgccggaaagctgctgagcgcgcgcggcgtggaatacggcatcgagatccgtgcaggcgaaacgctgctctatcgctacgaggacaacgcttttccgaaaaacacgcagatgaagggtcgcctgtgggcggatgcggagcttccggacaatatcagcggacagacgctcagcctgacctttacgcagctttccgaccggaccggcaggtttgacgcgcctctgctcggctcggtgcggagcatcaccggccaccatatccagacctcactgttttccctggtcatgatgctcgccatggtcatccttgccgtgctggcgctgctgatcttctgctacatgagcagctgcggcatccgcgagcgccgcttcctcgatgtggcggtctttctgctgctgtgcagcctgtggtgcctgaccgattccgctctgtatcagatttacggacgggatactgccgccggaagcgtcgtttccttttacgcctttatgctgatgtctatcccgatggtgcattttgtccgcaacacgataagcggcagacggcggctcgttcccgatatatgcattgcgctgttctgcgccaacgcgctcgcacagggcgcggcgtaccggcttttcggcatccggtttattgatatgctgccgctgacgcacctgcttctggcagcaggcgtcgcagcgatgctgaccgtgctgcttcggtcgtaccgtgagcagccctcgcagcagctccggctgcgtattgcggcgttcgccgcactgggcgtgttcggcgtggcagcgctcgtcctgtacggcctgctgcacatctattggtacgatgcaatattccagtttggcgtgctgctgttcatcatcctgctcttccgtgagctgctcggacaggcgaccgaggatatgcgttttcacatggagcaccgcatcagccatcagatgcagcgcgaggatcgtatgaccggtctgccgaatcgccgcgcgttcgaggaatacatggagcgcatccgcaccggcgaggtcggatgccgcgacgcggtactgacctatatccggctggagggcctgaacgagcgcaacgatcgcttcggccttcaggcaggagatgaggcggtcatcgccgccgcacggtgcgttgcagacttctgccgcgcgtgcgaggacggaggcgaaagcgtatcgtgcttccgcaccggcggaaacgagttcgccctcatccgtcccgagccaagggcaaattcggggcagctgcaccggcagttcagcgcgattgtcgcgcggtacaaccgcacctgtgcgccgcgcgcccgcatcacgatgacctacggcttcagccgcctgtgcgacgaggacggaaaatcgcgcagcatcagcgcatggaaggcggaggcggacgcctatttgaagagaaatgaaaccagactgggaggggacacggaatgacaaccaatctacattatctgatcgccgggatggcggtgctgctggttgttctgtggcagtattcccatcagcggcagatggatgaccggaacagcctcatgttccgccgcctgctgactgtcgtcagtctggacgttcttgctgagctggtcagtacatgcttcattctgtacgctccgtacagctttggtgtcggccgcatgctctcgaacaccgtgttctatctgtttcaggcgattctgccgctcatgctgctgtactatgtctgtacactgtgctcgagccgcgtgatctccaccggaaccgtgctgcgcatgggcattccgactatcgctctgatctttatcattctgaccaaccccttcaccgaaaagctgttctatttcgacagcaccggctactgccacggtccgtggtatctgctgctgtacatcagcgccctgctgcacatcgcggcggcagcgatttttgtcgcggtgcaccgggatgcggtcagccgccgcaatctgacggcgctgcttacagtctttttgctggccgccttcggcatcgccgcgcaggccgtcaatcccgcggtgctgacgaccggcttcggcctttcgctcagcatcctcgcaatgtatctgaccatcaacaatccctgcgcgtgcatggacagcctgaccggactgaatgacaagcagtatctgctgcgccgcatgaacgagctgaccgacgcgcacaaggcctttcacattatcacggtctacgcctaccagcttgaccacatgaacaaagtctcgggcgtacagagcggcgacgaatttctgcgccgcgcggcagagcacatgcaggagatcgcgggcaggaacgtgttccgcgtgacaggcaagcggtttctgctgctgacgttctcgctgcgcgagtacgaagcctgcctgacgagcctgcggcaggtgttccacacgcagccggacgacgcgcaggccgctccctcgccggtcatcctgtgcggcgtggtgggcgcggaaaagctgggaacgggcggtcttgtgctggattatgcggaatatctcgaatctctcgcagcacgcagcggcgggactgaggtcatccagaacgaccgcaagaacagggacagcttttactacaacaagcaggtcgagcagttcctgcaccgcgcgatcgacgaggatttgttcgaggtctattatcagccggtctattcgctgcatcagcagcgctttgtcacccttgaggcgctcagccgcctgcggcatcccacactcggctggatttcaccggatatttttatccgccttgcggagaagaaccgccttatcagccagatcaccgagcttcagctgcggcgtgtctgccgttttctgcgcgaaaacccggcgctccgcgcaagcattgcgaacgtcaagatcaatctttcgccgctcgatcttattcacagcgatggcggcaaccacctgatccgcattctggacgaatacggtctgccgtattcctgcttccagtttgcgatcaccgagacggttgcgaccgagtattccgcgagcctgacccgggtggcggagagctttcaggcggccggcatcggactgtgtctggatgatttcggctcgggctacgccaacctgaatacggtcatgcagctgccgttctcggtcatcaagctcgaccgttcgctgctgttccacatctgcacggacaaaaacgccgcgctcttctaccagagcatcgtatccgccttctgccgtctcggctaccgcatcattgcggagggtgtggagacgcaggaggagatggagctgctgcggagctggaacgtggatatgattcagggctattatttctcccgtcctctgccgccgggagacctgctgcggctgctgactgaggaagccgtcgaacagatgtgaccgggtgcggcggaccgcctaaaaaatccgtgaaaaaatttttcagaagccggaacctttttagacgtgcttcgtctaatagagagaaagagatcagatactgctctcttagaaagaaggctttttacatgaaaaaaacactgatggtatttgcatgcacggctctgctggctgcatcgctttcggcctgcggcagcaagcccgccgaaaatacggataccggtacagcatcgtctgcggcggcctcgtcctcgagcagcgaacagcagcaggaaaacacgctcaccggctcgctcgatgagaagaagaacggcatgttcgttgtaacggatgccgagggtgccgcctatgaatttacctacgatccctccgatacgccgaagggtctggacgatgtcgcagagggcgattcggtcactgtgacttatacgggcacagtatccgaggttgattcgtttgacggcacggtcgtttcggtcgagaaaacggaggcagcacaaaattaaagacgcggctccttgcgcaggctccggtcgcgctgccgcggctccttgcgcagactccgtcgcgctgccgcggctgccgcttggaaaaaacgcaaaaaaatcccctgccggggacagattttctgtctccccggcaggggatttcgtttttcaggacttttgctctgccttgtccagatacatcagataatccgccttgcggatagcctctgtgatcggatgcacgccgcagatgccgccgatgctgaccgaaagctggacatccgcgaactccgacatacggatgccgcgcacggcctgctgaatctgctttttcttgtcgaggaaagcctcctcggtcatgcgcggaaacagcagcaggaattcatcgccgccgtagcggatcagaatatcggtcttgcgaatgcaggaacgcaccgcgtttgcgatgtcgcgcagcgccgcatcgcctgcggcgtggccgcagcgatcgttgatgagcttgaagttgtttacgtcgatcagcgccacgccctccatgccctcaaggtgggtgcggtaggtttcaaaatagcggcgcgaatagacgttggtcagcgggtcaaggaacagctgcatatcctcgccgcgcgtgcggtcaagcagaaaacgcgagccgtttgcgtcaatccagcggccctcgttgagccgcgagaccagctcgagcacgcagggcgtgccgttgatcgtaatatacttggagatgacgaaatacatctcatttcgtgtaaattcgagcttgttgagcgtagtatgctcagcaaacgcccgtgcggagatgcagttggcgcagcccgcatcgttatcccagaacgcggcgcagcgctcgcctgtgcggtgcagaatgccgtccgcatcgagatcgagcacggcgtattttgtcgggtcaaccagacggacgacatcaaagaccgtgctcagacgctggatatcgttggtgatcgacggctcgtccgtcgcgcttttgtctgtgcagcggaagggcacacagccaccctgcaccttctgcgcatcggtcagacagccgatcacgccgacatagtgaccgggggagaacggcgaccagagcgtgtgcatccggatgttgtgccagtgctgcttgcgcccgaccggcaggagcaggctgagcgaaagctcgttgttctcgggtgttgtggccttgagagcggctctgagccgcgcaatatcggccggtcgcagcagtcggagactgtccgtttcatgcacgtccagtatcgtgcactgctgctgacgcggacggctccggtcggctattatgatggtaccggcaggaacgtcatactcaaactgcacatcgccgcagcaggagacaaagaaatccagcttttccttgacataattcagctcgcgctgggcgcggtcgctgtgcggtacagcgctcttttgcagcagctcggcagacaggcgcttggcgtcgcggcggagcacctgatcggcggcaagcgtcggcagtgcactccggaggcgcatgctgatctcctgcaggcagtcgagcagcatcgggttgaacgcgccgcactctccgttgaggatcatggtgatggcggtgtcgtgggtgtatgcctttttgtagcagcggtcgctggtcagcgcgtcaaatacgtctgccagtgcgactacctgcgccgagatcgggatctgttcaccgagcaggccgtccggatagccgccgccgtcccagcgctcgtggtgccagcggcagatctcgatggcgaccttgaccagcggctcgtcgcggtactgcgtcagcccctcgagcatggatgcgccgacagcgggatgggtgcggatgatgctgaattcctcgggcgtcagtgcgcccgccttgttcagaatgttctcggggatgctgatcttgccgatgtcgtgcagggcggacgcggtggtgatgaggcggatcttttcctcggtcagaccatatacatcggtcttttcggtcagcttgcgcagcagcatctcggtcacggtctgcacctgaagcacatgctgtgcgctctcgctgttgcggaactcgacgatatgactgaggatgccgatcatgacatggctgtccttctcgttctgatagatctggtcggagaccatgcccatcagccgcttctggttggcgtagagcgtgagcgtgtttttgacgcggcgctgcacgatgaaggagtcgaacggacggcggatatagtcggtaatgccgaggctgtaacagcgctcgataaccgcacggtcctcggtggcggagatcatgatgactggcagctcctcgatccagcggaactgattcagacgctcgagcacgccgaagccgtcgattttcggcatattgatatccagcagcagcaggtcgatattcatatcctgctggagcatgaggatggcttgcgcaccgtcctctgcctccgcgtagtcatattcctcgccgaggatcgccttgagcatttctcggttgagttccgagtcgtcaacaatcagaattttctgtcggttcatagtcgttcgaccgcagccgggtcgccctccctccctttgtttaccggaatttgaccggcttcaccattttttattatactaccaatgtaatgcagaataaaggaaaatttccgtcagcgcccacggtcagcaccgacggcggaaatttctgttgtgcaggagtgcggcagcgtgtataatgaagagtaaactgtgccgatctgcggcacagacaacgagcaagagggagaggacaccatcattggtatgaacagacacaaacgggtaagatgcgctctggcgcttttgaccatgctgacggcgggtctgctgtccggctgcgtctcggatgcggcgtccgacagcacactcccgacgatcaccgtcggcagcgacacctatccgccttatgtctatatggacaataacggcgacattaccggtctggacgtggatattgcggaggaggcattccgccgcatgggataccgcgcggaattcaccacgatcgactgggaacagaaaaccaaactggtcgataacggagaaatcgactgcatctgggactgcttttccatggacggccgcgagaacgactatcagtgggcgggaccgtatctggtaagccgtcaggtcatcgccgtcagcgcgcagagcagcatcgagcgaatgagcgacctcgccggaaagactatcgcggtgcagtccaccggcaagccggaggcgatctttctgagcggaggcgaaaacgtcccggctttccgaaatatcatcagccttgctgacagcagtgtgcagtatgccatgctggacagcggctatgtggatgcggtagcggcacacgaggaggccatccggcagtatatgaaggactacggcgcgagcttccgcattctggatgaaccgttgctgacgaccggcatcggcgtggcattttccaagaacgacacacgcggtctggcggcgcagctgaccgaggttttcgcgcagatgcgcgaggacggcagcatggaacagctggtcggaaaatatctcgaggtccccgcgcacagtctggaggtggagcagcttgaacaataattcccggcgcattgtctcccgaaggacgttctggtgcctgtgcctcgcggcggggcttttgttcctcggcgcggtatttctgctgtcccggcacgcggatatgcaggactgcgagcggcgcatgaccgagctgatcgactttgtaaaggagcagtcctcctcctatgtgcagtataacgaaaccgccgtggccaaggcacttgtgcgcgaaacgaccgccgttcaggagctggacggcgtgacgctcgactgcggcgaggacgagctgcggcagtatgtggagcggctggggctgaccggtatttcagtgctggacgcgaacggcaggctggtctgcgagtacagcgcggacagcatcggctatacccgcctgcaaaccgatctggaagccgagcgcgtgctcgccgtgatcggtcatccgcagagcacctatgttcggcgcgtgcagctgaccgacggctcgtttgccgacgctgccgtgcgcagctgcgcggacggacgcggcgcggtgcttggctggcggcacaccgaggcggcgttcgcaaagaaatccgtgctctccgtgcagaatctgctcgacggctacgacgccgagatcacgggaaccgtgctcctgtcggacggcaactgcgtaactgcgtcggacgagccgtccctcatcggtacggataccacggaaaatgagctgctccgccgcatccgctcgagcggccatgccgaccggctggtctatgccggacgcaggggcctgacccgatactacggcatgtacagccacgggcgcaacttctactactatatatatgtcccgggcagactgctctacagggacacgccgatcaatttgatcgtgtcgttcttcgcctgtgcgatcgttctaacgctgctcctgttcgtgcggcgaggaacggaaaagagcttcctccagcagcagaaaacgctcgaaaaggaatatcagacctcacttgagcagaagaacgccgagcttgaacgcgctatccgtcaggaaacggcggcaaaccgcgccaagcgcgaatttctgttcaatatgtcgcacgacatccgcacgccgatgaacgcgatcatcggcttcacctcgcttgcggccacccatatcgacaaccgtgagcaggtgctcgactacctgaaaaagaccgcgacggcgagccagcatctgctctcgctcatcaacgatgtgctcgatatgagccgtatcgagagcggcaaggtttctctcgagctgcgcccggtgcacctgcccgagcttgtacacgatctgcgcgatatcatccagtcgagcatcaccgccaagcgcatctcgcttttcatcgacatggtcgatgtggaggatgaggatgtggttgccgaccccatgcgtctcaaccagatcatgctcaacatcctgtccaatgccatcaagttcaccccggtaggcggcatgatcaccctgcgcatcgttcagaagcagaccgcaccgcatggtagtgtggattatgaatttcatatccgtgataccggcatcggcatgagctcggcgtttcaggagcatatcttcgagcagtttgcgcgcgaggagacctcgaccgtgagcaaaattcagggaaccggtctcggcatggcgattacgaaaaatctggtcgatatgatgggcggcagtatttcggtcgagagtgagccggggaagggctcggaattcacggtttccctgcgctttcccatcagcggagagcaggccgcgccgcagcgtatcccgcagcttgagggtctgcgcgcgctcgtggcggatgatgacaccgacacctgtctgaacgtcagcaaaatgctgcgcatgatcggcatgcggtcggactggacaacctcgggacatgaggctgttgtccgcacacaggacgcgatcgagcagggtgacggcttcgatgtctttatcatcgactggatgatacccgatctgaacggccttgaggtcgtgcgccgcatccgcaggctgattggcagcaacaccccgattatcatcctgaccgcctacgactgggcggatatcgaggttgaggcaaaggccgcaggcgtgactgcgttctgcgccaagccgctgttcatgtccgagctgcgccgcatactggctgagccgtttcttccggcagaggctgcggaacagacggagaaaaaggcggatttcgccggaaaacggctgctggtcgtcgaggataacgccctcaaccgcgaaatcgcggtgacgatgctcgaggaaggcgggctcgaggtggacacggcggaaaacggaaaggttgcggtagacaaggtgcgcgagagcgcgcccgggtactatgatctggtgctgatggacattcagatgccgatcatggacggctatgcggctgcgcgtgccatccgcgctctgccggatgccgaaaaggcgggtctgcccattgtcgccatgacggcgaacgcctttgacgaggacaggcagaacgcagagaaggcaggcatgaacggccatctttccaagccgttcgatatgcagcagctgctcacgatgctccgggagaagctgtcgtcgtaacgctttcattttcatcgcgttattcgataatgaagccgccggatcaggctgaataggaaacgcaggaagcgtccgtttgggatgccttcctgcgtttttctttgcacaccgccggtgcggcgtttttttaccttttctgcccggaaaaggtttacattgcttatcaattggcttatgataaaatctgacaaaggaggtgggcctgtgcacggagtacgtcaatggtgggtgcgtctgtccattttgcacaaggcgatcgtgctgagctgtgcattcgtcattcccattctgctggtggtgggactgctaatgaacgatttttacgattaccgcgagaaaagcgatgatatcctgtctgaatatgcacgctgcacagactacatgaacgccatggagcaggaaaatgcgcttctgggcgagctgacgtttgcggcgcccgagtccgatacgatcgacaaatatgcggacgccgtgcaggacaccgcctctgcgtgggtgcggctgcgcagcgcagagaccgacggcagcacgcagagcgaggtgcttaagcaggtcatcgaccgcacgatgaaaagctatcgtgtccgtcaggagacgttcatcgcgcagctgcatggcggcacatttgacgcggtgaactacgaagcgctgcgtacacagggcagttatctgacgcaatataccgatcagctgacggcggcgtttctgatggagggacgcgagggctatctggtcctcggtcagcggggtacctcgcagaacatggtatttaccatcgtagccgcgatcggcagcgtgctgtttgcaggcgcgatgctgtactacgcacgcagcctgctgctgccggtgcagcagatgagccgcggtgcacgccgcgtcgcggatggcgaatacgacattgaggacttcaactttgcacgctcggacgagatcggtatgctcgccgactcgttcaaccacctcaagcaccagatcgcgcggacgattcacgcactggaaagcgaagcacagctggaaaaatccctgcgtcagcaggagagcgaggcagcacgtctgcggcagctgatcgagcagagccgctttgcgcagctgcagagccagatcaacccgcattttctgttcaacacgctgcagagcgtggccaacatggctggaatcgagcaggcgaccgtcaccggtgacatggtggtgcggctggcgaacttcttccgctacacgctcgaccatgacgacagcgtggtaacactcgaccgcgagcttgcgctgctgcgcgactacatttccctgcaggagctgcggttcggtgaacgtatttcgttcgagatgaactgtgacagccgctgtgcggcctgtgaactgccgaaattcacactgcagccgattgtggaaaactctatcgtacatggtatgcgcagccgcagtgcgggcggccgcatccgcattgtcactgagagcacaccgaatggctgccgcatccagattacggacaacggcggcggcttctcgcgcagcaaaatgaaacagaacaccgccgagggacaccggtccatcggcctgcagaatatcgcgggacgcattgcgctgtccggtggcagcttccgtattgtcagctgtcccggattgggcacgacagcccgcatcatactgcccatgaaaggggaagagcatatatgttaaaggtactgatcgcggaggacgaaccgctgagtctgcagaatctgagcggacagatgcgcgatttgcttggcgcggatgcactcatcgagggagttgcgaacggacgggaggcggttgaacgcgcccgtcaaattcagccgcagctggtgctgatggatattgaaatgccggtgatgaacggccttgatgcggcagccatcatccacaaagccatgccggaaacccacattgtattcctgactgccttcgaccgcttcgactacgccgtaggcgccatgcgggccggcggaacggattatctggtcaagccgtttgacagcgcacagattaccgcctgcctgcgcaagctgaatctgctgccggaaagccgtccggcggtgcgcggggacaagccgggaaatacgttctgcacccagttttccgtgtggctggagcatcattacatgcaggatgtgtcgcttgatcaggcggcagaggcgatgggcatgagttcgttctacttctcacgcttttttcgcacctcgtataaccagaccttccttgaatacttgaccgcctaccgtatcgaccgtgcggttgagctgctgcagcagactgatattccggtacgggaaatcgctgttcgggtcggctatacggatgcaaactacttcacgaaggtgttcaagcggcatttgggcgtaacgcctaccgagtaccgcaatcataacgcaaactgaacgagccgcgcggcaggatttacggaatttatacggaaatttactattctttccaaaatgtttatgcaaatgtcataaaatagaatgtgaaaattttcagtacgctgtgattttacctgtctaccgcaagtatttacgatgttgccgaaactggtcaccctatataataggagatggaaagatgaataaacgctttcggtgtgtgatcgccggatggctgctgctcatgctctgtgcatgtaccggcggcacggacgagccgcatatccgctattaccgccttgccagcgggcagagcgaaaactacctcgccaatcaggcgtgtcagcgcttctgcgacatggtgcgcagggaaacggacggcgcgatacaaattctgccgagctttgataacgagcttggtaccgatgcatccgcacttgagcagtgcgtgtacggcggcattgattttgtacgcacgccaatctcgtctgccgcagcgtatgcaccgcagcttgcggcactgcagctgccgtacgagtacacctcggacaagcacctgttccgggtgctggacggcgcagtcggtcagcaggtgatggcctcgctcgagaacaagggccttaccggtttaagctatttttatgccggttaccggtgctttttcacgacaggaaaggcgatcacctcactcgatgacatgaaggacctgcggctcggcaccgaggattcctcgcagatgaagcaggtcattccgatgtggggcgccgaggcggtgacgctgccgccggatgagatcgcgctcgcgctccgcactgaccggattgacggcgccgagagcacgctgcctacctatgtggacagcggctactatcagcttgcaccgtactggacgtacgaccgacattcctacaacgcggatgtgctggtcgcgtcctcggaaacgtgggaaacgttctcacaggaggagcagaccatcattgagcgatgcgccgctgaggcggcttcgtggcagcgcgaccactggcagagcgcagaggttcgagcaatgctgcacgcatcccgcagcggctgctacatggcgctgctcgatgaggagcaggccgaaaagttccgtgcagcggtgcagccgatttacgaacacctttccgatgcgcagaaggaggtcgtgcaggccgtacaggcactggccgacagcgattagcgagaactcctccttgtgcatgaccagtttgttcgcaaacgtccgtaaaacggcgttttcgatagaggaaaacgaacaaggaggctaaaaagatgaaaatcaaaagattgatggcaggtctgctttgcggtgcagtcggtgcggcaacccttggtttgtccggctgcggcaatgccgcggacagcggcatgatggatgcggcaaacgccaatgcagttgcaggcggcagcagtgatctgccagtcattacctggaagatgggttctacctggggtgacggcaacattcacttcacctgtgacgagcgcttctccgagctggtcagccagctgaccgacggacgcttcaccatcaccaactatccggagggctcgctctgtgcggcaaaccagctgtttgattacgtccagaacggcaccatccagtgcggcggtgactggggcggctactggagcggcaaggataccgcttttgagctgctctccactacaatggataacttcaccggcatggactactacatctggatcacccagggcggcggcctgaagtgctatcaggatatgtacggcaagtacaacatgacgtatttcccgattatgatcaaccacgcagagtccggtatccgttcgaccaagccgatcacttctatcaaggacatgcagagcatgaagatccgcctcggcggcgttatggccggccgtgcagcggaaaagctcggcatcaacatcaccaccgttgcggcaagcgagctttatgagtccctgcagcgcggcgttatcgacggcggcgagttctccacgccgtgctcggatgattcgctgaaattgcaggaggttgccaagtactggtgctcgcctgcatggtatcagtccggcggcgtcaacggcgttatgatcaacaaggatgcatggaatcagctccccgaggagtaccagaacgccatccagatggcggctgagatctgcacctccgagcagctgtcccgctacctgtggatggatttcgattccaccaagaagatgctcgaggaggacggctgcgtcgtcaccaagatgaaccaggacgactggaataccatccgtgaaacctgccgtcaggtttacgaagaagaagctgcgaagaatgaaaacttcaacatggtatacagctctatgcaggattaccgtgaacatgccgatacctaccgtgcaatgctcggtgactacggctggggcttcaactacgatgaatccgaaaagtgaccgacagagtgttccgtgctctcttttgagagcacggagcctcagaagatgaggtgtaatatatgaaagtgatcaaacgcatctgcgatgtgatcgacctcgtcaatgactggatcggcaggattgcttccttcgccgttcttggcattctcgcggtcattgttaccgaagtcgtgctgcgccgtttgttccacagtccgcagatctggacgatggacgtcatctgcatgaccttcggctgctacattatcatggtctgcgcctacggcttccagaagaaggcctttgttgcggttgatgtgctgtatgcacggcttaaaccgcttgcgcagaacattctgcacctgattacctatctggtgttctttgttccgttcgtattcgtgctcgtgcccgagagcttcggatttttccttcgctcgtataccacgggtgagcgcggctactcggtatgggcgccgccggcatggccggtcaagctggcgctgttcgtcggcatgacgctgctcgcactgcagggcatttccgagatgctcaagtgcgtgcgcggcatcggtgaagccgtttccggcacggatgatacgaagggaggcgacgctgcatgatggaaatgctgaccaatcttgtcacgcagtccggcgtgagcgcaacacagctcagcgcgatcctgcttggcgtactgttccttaccatgatcatcggtcttgcgaccggtcaggagcttgcgttcgtcctcggcggcgccggtgttattatcggctatctcgcctggggcggcccgggcatcaccatcgccatgaccaaggtgtacgaccagatgcaaagctattccatggtcgccatcccgatgttcgtgctgatggcaaactttttgacacattccaaggtcgcggatgggctgttcctctctatccgctacctgcttggtcctctgaagggcggtctcggtctggcagtgatcgtggtttccaccgtgttcgctgccacgaccggtatcgtcggcgcatccgttgttaccatgggtatgctgtccgtaccggtgctgctgaagtgcggctataagccgtctctcgcgtgcggcatggtgtgtgcgggcggttcgctcggtatcctgatcccgccgtccatcatgctggtttcgatgggctcctatgcgaatgtatcggtcggcaagatcttcttcgccgccatcgttccgggtcttgtcctgtcgctgttctacatgatctatgtgttcgtcatctgccacattcacccggattacggtccggcgatgaccaccgaagagttggctgccatgccgctgagtgagcgcatcaccggttcgctcatcaacctgatcccgccggtcatcctgatcgtcggcgtgctcggttctatctttaccggctgggcaaccccgaccgaggcagcaggcgtaggcgcactgttctcgctcatcctcgctatcttctacaagcagttcagctggaagatgctgtacgattcgctgatcgacaccgcaaagacatctgcgatggtattcatcatcctgttcggcgcgtctgccttcaccggcatcttcatgtcgctcgacggcgaccagctgattgcaacctggatttcgagcgttggcatcggcaagtggggcgcgttcgcaatcatgatggcgatcgtattctttatgggtatgttcctcgactggctgggcatcgttatgatcgtattcccaatcttcctgccgattatggatatgttcggctttgaccgcctgtggatcgtcgcagttacggctgttatgctgcagacctgcttcatgacgccgccgttcggcttcgcactgttctacatcaagggcattgtgccgccgtcggtcaaaatacaggaaatctaccgcggcgttatcccgttcatcctgattatcatcgcagtgtaattctggtaacggtattcccgcaggttgtatatttcctcccgaatctggtagcatcttaatctttctcctgagccttccggcagtcacctgtgccggaaggctcatctgcttgttacctgtgttatttcgcagttcaatgcggttttcctcttaccgtattaccgtaaagtgggaaatatgtagatgtgtttgaactgcggaataaacttctgtctgccggattgttggagtatttgccggcggcagaaccccctccgggctctctgatctgttgaaaatcagagagcccttgcttattcttgcgtggaaaaattccgcaaatcgcttgacttctcgaaaaatttcgggtataagattatattggacagacaaaaattcgatgatatactattatataatgcatgcctgttcaaagcctgaacggtatggtcaggctcggtttgtcgaaaaggtcaatattcatgcagcttcagccaattcgcgcagcagcgcgtataaaatagcatttgctttgcaaatgcaaaaaagtcggggcgtgtaccgcgcagcgcggccgagaaaccgcgcaaggacagcgctgacttttttcatttctggagggagaaagtttctgtattggaactttcggacgactttggaacggcccgcggtccgttcctgcttgtcggcgaaactgtactttcgccgacagcctaagcctgaacggtgcgttcaggctttcggtatatcatactgcagcatcgttaaaggaggggatttatcgtgcagacgcagatttttatggtgcataagcggcatctgggactgcgggcgccgacggtgcttgccgtcggctttgcgctgacgattctggtgggtgcgctggtactgatgctgccggtttcggcggcagacggacagataacgccgtttctcgacgcgctgtttacagcagcctcggcgagctgtgttaccggactcgtcacggtcagcacggcggtgcactggtcggtattcggcaagtgcgtcatcctgctgctgattcagatcggcggactcggctttatgtccgtcgcggctattgcgtcgtttgtcctgcggcgaacgatcacgctgcacgagcgcatggtgatgagcgcggggcttaatctgtcggacggcggcggcattgtccgtctgacacggcgcgtgctgttcggcacgttcatcatcgaagggacgggagcggttctgctgtcctgccggttcgtgccgcattacggtttcccgaagggaatcacaatgggcgtgttccacgcggtttcggcattctgcaacgcaggctttgacctgatgggcacaccggacgatccgtttcagtcgctcatcggctgggcggaggatccgctcgtgaacattacggtgatggcgctcatcgtgctcggcggtctcggctttttcgtgtggagcgacgtgtgggacaagcacagtttctgccgtctgcgcctgcacacgaaaatcgtgctgacggccacggcaggtctgctgctgttcggctttggctggacgctgctgttcgagtggagcaatccggcaacgctcggtgcgtttgatactccgcacaagctgcttgcggcggcgtttgagtccgtgaccctgcgcacggcaggcttcaacaccatcgatctcggcgcgcttaccggcccgagtcaggcggtgtcgtgcctgctcatgttcatcggcggatcgcccggctcaacagcaggcggcatcaagaccgtgacggcggccgtgctcgtgctcacggccatcagcgccttctgcgggcgcacaacggtttcggcgttcggccggacgattgcgccgcgcagcatcatgaacgccgtaaccctgctcatggcaggcggcgtgctctgtctggtcggcgcctgtgcgatcgccggaatcgaggacgcaccgtttcaccagtgcctgtttgaagcggtctccgcgttcggcacggtcggtgtgagcatgggtctgacaccgacgttggcggcggcttcgcgcgttattctgatcgtgatgatgtatatgggccgtgtcggtgtgctgacgctcggcgttgccgttttcatgcgccgcagagagccgccaaggctcaaatacccggacgcagatgtgtttattggttgaggcagcattccgcaattacatttttggcattttgcgtgatgatgcctttatggtgaagtagattaagcagttatccaaaggagagacagatatgaaatcctttctggtgatcggcatgggtcgattcggtaccgccgttgcgcaggagctgaccgagcttggtcaggaggttcttgccatcgacgagaacgtcgagagcgtgcagcgcatcgcggatgatgtgacgcaggtcatgcagggcgacgcgcaggacgaagccgtgctgggggccgtcggcgtgcgcaacttcgactgctgtattgttgcggtaggtacggatatggaggcgagcatcctcatcacagtcatgctcaaggatctgggcgcgcaatacatcattgccaaagcgagaagcactgtgcatgccaaggtgctcgagcgcgtcggtgcggaccgtgttgtcctaccggagagcgaaatgggctgcaagctggcacagcgtctggcacatgccaacgtggtggattttatcggcgtgtcggacgaatacagcattctggagatacacgcgccgaaaagctgggtcggcaaatcgctggtgcagcttgacgtgcggcagaagcataaagtgaatgtgctcgccgtccgtcatggtgaacagggtgcactggatgcaagtcctaagccggatagggccatcgagccggatgatcttctgtttatcatgggcgaaaataaatttgtgagcagggtggtggaactgcattgattgagatacagagccgtcagaatgccgcgctcaagcatcttgcgcggctgggacgggaacgaaaataccgccggagcacgggggaaatgctgtgcgagggcgaaaaaatgctgggagaagcactgcgttcgggcgcgaagctgaaaaccgtgcttgtgagagacggctgggacagtccgctcgtcaaagaggcggaagagcagggagcattgctctattctgcgccggatgcgctgttccggcttgccagcgaggtggaaacgccgcagaatgtgatcttttcgtgtgtgcagccgcagtggacggcagaagcgctggacggagcacagcaggtgctccttttggacggcttacaggacccgggcaaccttggcacgatcttacgcaccgccgaagcgttcgcgctcggcgccgttgtgttgtgcgagggctgcgccgatccgttttcacccaaggtcgtgcgctcgacgatgggcgcggtgttccgtctgccgtgcgtgacgctcccgcttgcggaggccgccgaacggctgcacaggaacggtctgccgctgtacgccaccgcgctgcatgaggacagcgtgccgctttcctcggttttgctttccaaagccgccgttatcatcggcagtgagggaaagggcgtgaccgagcaggcgctccgtctgtccgacaggcgcgtgatcattcccatgaagggccgtgccgaatcgctcaatgcgggcgttgccgcggccatcgtgatctacgaaatgacaaaatgaggaggcgggcactatgccgtcaagactcagctatgtttggctttcgctcaagcgcggactcggctcgcgcacagccgccgaggtactcgatgccttcggctctccggaggcggtgttcgccgccgaccggcaggcactgacagctgcgccgtgtgagctgcgcaagacccatgtcgatctgctgtgcgacaaggatacgtccgaagcggagcaggtcatccggtcctgcacggaaaagaatatccagatcattaccatcggtgacagcgcttacccggaccgcctgcgggcgatcccggatccgccgaccgtgctgtatgtgcgcggacgctggccggatttcgacagcgttcccgccgtagccgtcgtcggcacgcgcaaggcgacgtcgtatggtctgaaagtcgccgatcagatcggcacaacgcttgcccgagcgggcatgataaccgtcagcggtatggcgctcggcaatgacggcgcggcacaccgcggtgcgctgaaggcgggcggcctgaccgttgccgtgctggcgggcggtcccgatgtgtgttatccgccgcagcaccgcagcctgatgggcgatatcctgctcatgggtgccatcatcagcgaatatccgcccggcaccgagccgcacggacgcaattaccaccagcgcaaccgcattatcagcggcctgtcggtcgcgtccgtcatcgtggaggcgagcgactggcgttcgggtgcgctcattaccgcgcgtcacgcgcttgatcagggacgcgatgtgtacgccgtgcccggtccgatcgacgcgccgcagtcgcagtcgtgcaatgagctgatcgccaagggcgaggctgcgctgctgaccagtccgaccgtgctcgtgcgcgagtacagcggcatgatgcccgagcaggcggtacagcaggcgttccggcgtcagaccggcgagtatccggaaccggctgccagaagtgcttgggaggacattcgcaggcgtgagcagcaggccgaacagcgccgcgccgctgccgcagaaaaggcgaaggccgaacccaaacagccgtctgcggctgcaaaaccgctgccggacggcttaaatgaggatgaaaggaccatcgtcacgctcgtgcgggacggtgtgagcacgcccgaggagctgatcgaccgctgcggtctggcagcgccgcgggtgatgagtcttgtcaccatgctggaaatggatgggattctgcgccgtgaaaagggcagactcatcctcggcacatggtaaaagtgagagaaaaaagaaaacacgcagcaatcacgccgtaaggcgtgtatgcaatggaatttccgcaggaaattcataaaaagggggagcatgtatcaccctttttatacaagtgcggagaaaggtttcgacgaaggaggaacttttcgcagccttggccatatctgaacagagttcggtatggcctttcgattgcaagcgtggttgcaatcgaagtaagtttttggaggtttttatgtctaagttagtcatcgtggagtccccggccaaggcaaagaccatcgggaagtatctcggctcggactatgtcgtcaaggcttcgatgggacatctgcgcgatctgccgaaaaagaaaatgagcatcgatatcgagcacgatttccagccggaatatgtgccgatcgagggtaaagataaaatcatcaaggaaatccgcagcgaaatccgcaagagcgatttcgtctatctcgcaactgaccctgaccgcgagggagaagcgatttcgtggcacatcaaggagctgttcaagctcaaggacaaaaattcccgccgcgtgacctttaacgagatcaccaagcaggcggtccgctcgggtatcgagaacccgcgcgatattgatatcgatctggtaaatgcacagcaggcacgccgcattctcgaccgaatcgttggctatcagctgtcgccgttcctgtggcgcaaggtcaagcgcggtctgtccgcaggccgtgtgcagagcgttgcaacccgtctggtcgtggaccgtgagaacgaaatccgcgcattcgtgccggaggaatactggtcgatcgaggccctgctgcagaccgcggacggcggcaagttttcagcgcgctactacggcgacgcgaacggcaaggccgagctgaaaaacgaagagcaggcgatgcatgttgtcaacgccgttaccggcaagccgttcaccgtcggcaatatcaagcgcggcaagaaaaaacgcaccgccgcacctccgttcatcacctcgacgctgcagcaggaagccagccgcaagctgaatatgacgccgcgccgcacgatgagcatcgcgcaggagctgtacgaaggtattgaactcggtgaatacggtctgaccggccttatcacctatatgcgtaccgactcgctccgtctggcggacgaggccaccgctgccgctgcgggcttcattcgcggccgctacggcgaggaatattatccgggcaagccgcgtgtgttcaagaccaagggcaacgcgcaggacgcgcacgaagccattcgtccgtctaacgtgcagctgctgcctgaagaaatccgcaagtacctgacgcccgatcagttcaagctgtaccgcctgatctggtcgcgctttgtggcctgccagatggcagacgccattctcgacacggtttccgccgatatcgtctgcgagggtcaggtgttccgcgcatccggtcatacggtcgcgttcccgggttttactgcggtttacgaggaaggcacggacgacgagaaaaagcaggattccgcaggaaagccgctgccgcgcttcgatcagggcgacaagctgaccgccgagaagatcgagccgtcccagcactttacgcagccgccggcccgctacaccgaggcatcgctcatccgtgcgatggaggaacgcggcatcggccgtccgtccacctatgcgccgaccatttcgaccattatcgaccgcgattacgtcaccaaggagaacaaggcgctccgtccgacgccgctcggcgaaggcgttaccggcctgctggttgacgagttcaagtcggttgccgattacgagttcaccgccaatatggagcacgagctggacgaggtcgaagcgggcaagctgaactatatccagctgctgcacaacttctatggcggctttgaagccgcgctcaagcaggcggagatcgatctggagggcaagcgcatcaagattcaggacgaggtgaccgacgttatctgcgagaaatgcggacgcaacatggtcatcaagtccggtcggttcggcaaattccttgcgtgcccgggtttcccggagtgcaccaacaccaagcccatcaccgaggacaccggcgcggcgtgcccggtttgcggcgcaaaggtcgtgaagaaaaagtctgcacgcggctatgtgtattactcgtgtgacacctatccgacctgccagttcatgacgtgggacaagccgctcaagaccaagtgtccgaactgcgattcctcgctgttccgccacaccgaccgcgattccaaggaggtcacggacgtttgcctgcgtgagggctgcggctacaaggagctggtcaaggagggcctgccgcctgaggaaaccgaaaagcgccgcaagatgcgtgaagcgcgtgccgccaaggctgcggaacgtgctgccgcaaaggaagccgccgagaagaacggcgagaccgaggaaaaggtcaagaaggcaacgaaaaaggcaacgactaagaaatccaccgcaaagaaaaccctgccgtggatgaccaagaccaccaataaattcaaaaagctgaaggacgaggctgtacaggagctgactgccaagcagcaggagcagtacgccaaggctctggcaaagtatgaagcagaaaaggcggctgaaaaggcgaaaaaagccgctgagaagaaagcagcagcgaaaaagcctgccgcaaagaaaaagaccacggcaaaggagagcgccgaatgagtgaaatggtaacagtagtcggcgcaggactggccggctgtgaggctgcatggcagctggcgcagcgcggcatttccgtgcacctgtgtgagatgaagccggtgcagcacacgcctgcgcaccactcggacgatttcgccgagctggtgtgctccaactcgctgcgctcggatgagctggcgaacgccgccggtctgctcaaggaggagctgcgccgtctggacagccttatcctctcctgtgcggatgcacaccgcgttgaggcaggcggcgcactggcggttgaccgcgaagccttcgcggcagccgtcaccgagaagatcaagaaccacccgaatatcgaggtggtctacggtgaagtgaccgagattccggaaggcagagtcgttatcgcctcaggcccgctgacctcggatgcgctgttcgaggccatccacgccaaggtgggcggcgatttcctgcacttttacgatgccgccgcgccgattgtcacggctgagagcatcgatatggattccgcctacgaggcgtcccgctacggcaagggcacggcggattacatcaactgcccgttctcccgcgaggagtacgaggcgttctggaatgcactgaccaccgccgaggaagcgccggtgcacggctttgaggactccaaggtgttcgagggctgtatgcccatcgaggtcaacgcgcgccgcggctttgacacgctgcgtttcggcattttgaagcccatcggtctgccggacccgaaaaccggcaaggatccgtatgcggtcctgcagctgcgccgcgacaacgcgaacggcacgctgtacaatctggtcggctgccagacccacctgaaattcggtgagcagaagcgcgtgttctccatgatcccggcgctccgtaacgctgagttcgtgcgctacggtgtcatgcaccgcaacacgttcctggattctccgcgcctgctggacgcgacttacgcgctcaaatccgacccgcgcatccgttttgcgggccagatgaccggcgtagaaggctatgtggagtccaccgcctcgggctgggtggcaggcgtggcaacggctatggacgtgctcggtaaaccgatgccgacactcgaccgtctgaccgctaccggcgcactggcagcctatatttccgatcacacggttgcgaaattccagccgatgaacgtaaacttcggcattatcgagccactcggctataaaatcaagggcaagcgggagaagaacaccaaaatctccgagcgggcgctcgagcagatcgaaaaactgaagggagagctttaatatgaggatcatcgttgatgcgatgggcggcgataacgcgcccgaatccgctgtatggggcggtgcgctggctgcgaaggaatacggcgaggaagtgctgctggtcggcaagccggaggtcgtagcgaatgtcctcaaggagaagggactttccgatgtcaagggcattaccatcatgcctgcaaacgatctggtcgatatgcacgacgatcccgcaacggtactccgccgcaagccggattcgtccatggcggtagcgtttaagctgctcaaggccggcgagggcgacgcgctcgtttccgcaggcaacaccggcgcgctgctcaccggcgcaacgctgtacggcggccgcatcaagggcatccgacgcggtgcactggcaccggtcatgccgtgcgcgaacggtcaggtcatgctgtgcgatgcgggtgcgaacaccgaatgcaccgccgaaatgctgctgcagttcgcgttcctcgcttcgctgtatgcggagaagataaacggtgtcgtcaagccgcgtgtcggccttgtcaacaacggcacggaggataccaagggtgatccgctccgcaaggaggcttacgcgctgctgaaaaaggcgggcgacgagggtcgcctgaactttgtcggcaacgtagagggcagcatggtgccgctcggtgcgtgtgatgttgccgtctgcgacggctttaccggcaatgtgcagctcaagaccatcgagggcgtggcgaagttcatgtcgaaggagatcaagggcgtgtttatggcgtctgtcggcaccaagctcggctatttgctgtgcaagaaaggcatggacgacttccgcgaggtgttcaatcaggacaagatcggcggcgcgccgttcctcggcatcgcaaagccggtcatcaaggcgcacggctcgtccaacgagatcgcggtgatgaacgccgtccgtcaggccatcgcgtacaccaaatccggcatgatcgatgcagtaaaggaaaacattcagtacatgacggtttccgagtgatccacaggaagaaggaacaaaaatgctgaaaattgactataaattcaaggacgagagcctgctccggctggcgatgacccattcgtcctatgcgaatgagcaccacggcacgcatttgcagtgcaacgagcgcctggagtttctgggcgattccgtgctgggctttgtcacggcgggctatctgttcacgcactatcccgacctgccggagggcgacctgaccaagctgcgcgcggcagtcgtctgcgagggcgcactggatgagatcgcgcacgagatcggtatccccgaagccatccgtctgggccacggcgaggagatgggcggcggacgcaagcgtgcgtccattctcgctgacgcaacagaggctttgctcggcgctatctttatggacggcggcatcgagcctgcccgtacattcgtgctgcgcttcatcccgcacaaggtcgaggttgcgctggcaggcggcgcgttcaaggactacaagaccatgctgcaggagatcgtgcagaagaacaagcaggaaacgctggaataccgtctggcagggcagtccggcccggaccacgacaagcggttcaccatggaactgctgctcaactccaatgtgtttgccgagggcattggcaagagcaaaaaggaagccgagcagatggcggcgaagaaggccttggaaaatatgggatgctgacgcttatcgccagaccgcaatagagataaacggcaaagaggtcgagaaatcgacctcttttttctgcgtgacgcagttagtcgttgaaaagatactgccgcagtggtaaaataaaactatctataataaagaggtggcatatggttctcaaaagcctgattttacagggcttcaagtcgttcccggatcgcactgagatcaaatttctcggcggtattacggcgatcgtcggtccgaacggctcgggaaaatcgaatatttcggatgccatccggtgggttctgggggagcagtcctcgcggtctctgcgcggcgcgaagatggaggacgtgatcttcggcggcacagccaagcgcggtccggtcggctttgccgaggtttcgctcattctggacaattcggcgcatgtgttccgctcggaatttaccgaaattatggtcacgcgccggtactaccgctcgggcgagagcgagtatttcctcaacaaaaagcactgccgcctcaaggacgtgcacgagctgtttatggataccggtctgggacgcaacggctattccagcatcggacagggccgcattgacgagattctgtccttcaagagcgaggaccggcgcgaaatttttgaggaagccgcaggcatcaccaagttccgctaccgtaaggaggaagccgagcgcagactgtcagccaccgaggaaaatctggtgcgtatccgcgacctgtacggcgaactggaaaaccggctcgagccgctcgagcagcaggctggcaaggcgaaaaggtttctgcatctgcgggatgagctgcgcgtgcttgaggtctcgctgtggctgctgtcgctcgagcagctcaagaatgacactgccaagctgaataaagaccggacaacctgcgaaaagcagcttgcggatgcaaaacagcagcagggaacgctgtatgcgcagtccgagcagctggccgagtcactgcgtgagattgacagggaaaccgaacgtctgcggaacgagctgcgcgaagccgagcagtttgccgccgagcagatcagccgtgaggcggttattcaggctaacatccgcaactgcgaggagaatatcgagcgcacacggcaggagagcgcacaccgcgccgagcaggtgcagagcatggatgcgcagcttgccgaacggcgcgagcgtatttctgtgctgaatgagaaggagaaggcacagtcggctgaactggatgcactccgaaaacagtctgccgagcaggagcagcagcgtacacaggccgagcaggcacttcggcaggccgagcaggcgcagcgcaggcaggagcgcacgctgcacacgctcgaactcgaccgaacagccgctgagagcggtctggcgggcatgaacgaccgcaaaatgacgctggattccgaaatcgcagcagcggcacagcagctggataccgaaaagcaggcacaggacaatctcgagcgggaactgaccgcgtgcgagcaaacgcttgccgaaacggcaaagcaggcgcagacggccgccgctcaggcggagacctgccgccgaaaggccgagcaggcgcagaacgacctgcgagtagcgcagtcctcgctgagcgaaatgcagagccgcgtgaaaatgctgaccgacatgcagcatgagtacgagggcttctctcggtcggtgaaagctgtcatgcggcaggctgaaaagggtgcgatgaacggcgtgcacggtccggtttccgcgctaatcacgaccgaaaagcggttcgtgacggcaatcgacactgcactcggtgcgtcggcgtcctccatcgtggtggacagcacgagcgtgggcaagcagtgcatttcgtaccttaagcgcacggatggcggccgcgcgaccttcctgccgctggataccattcgggcaaacagcctgcgggagaccggcctggaacggcagaacggctgcttcggcactgcggatgccctcgtcagatttaatgaaaaatataagaatattgtgtgcaatctgctggcgcgcacggtcatttcggagaatatggacaccgcgctggcactggccaaggcgtacggacatcggtttcgcattgtcaccttagacggacaaatcctgcaggcaggcggtgccatgacaggcggctcggtctcccgcggcaccggcgcactggcgcgggcggaacgcctgcacgccgccgaggagcgcgtgcgcgcactcgagcaggagcgaaaaacgctggcacagaccgagcaggctgcaggacagaaactggaatcgcttgccgcgcaggcgcaggccatcgaaaccgaccgccggcacgcggagcaggagagagccggacttgctgcttcggtaaaacagcataaattcctgctggaaagcctgcagaaacggtatgacagcctgatttctgaacaaactaactttacagcaacgcagcagaagtatgaacagacacttgccgcctgcacagagcgccggtctgccgcagagcaggcgcttgcagctgacgagcaggtctgcgccgagcaccgtacggcagtgaacgccgctgcggaacagctgacgcagacggcttcgcgcatcacagccgtgcagaccgcgctcgcggagacgcgcacggcgcaggacagtgaagcacgcgcgctcgcggagcttgagcggctcaaggccgacctcgacgcgggcgtgtccggtgcggagcagacgatcgcaggctttgcggcggaaatcgcacgcctgaccgacgaactcacccacgtccgtgcagccaagcacggacgcgacaccaccgcccggctgctcagcgaacagcttgcgcggcagaccggcagacgcgaacagaccgagggcgaacgggtccgtctggaaaaggcggcacagagccgcaacgaggaaatccttgaactcgaacgcgagaccgcccgactggaaaaccgcgcggcccagctgaaaaccgaggaaacacagattctggataaaatgtgggaaagctacgagctgacacccacaccggcggcagagatcgccagaccgattgaaaacctcggtgaaacgcgcggccgcgtgcaggagctgcgcgtgaaaatgcgggcgctcggcaacgtcaatctggatgcggtggacgaatttcagcgtgtgcaggagcggtacagcttcctgcgggagcagaagaacgacctcgagaccgcgcagaccgatctgcgcaaggtcatcgagcagctgaccgtcagcatgaaggagattttcgcgtccgagttcgccaagctgaatgtgtacttccgcgatacctttcgtgagatcttcggcggcggacatgccgaactgcagcttgccgatacctcggatatcctgaactgcggtatcgacatccgcgtgtctccgccgggcaaggcggttaaaacgattacgctgctctcgggcggtgaaaaggcgtttgttgccattgcgctgtactttgcgatcctcaagctgcggcctacgccgttctgcgtgcttgatgagatcgaagccgcgctcgatgatgtaaacgtgcagcggtttgcaaaatacattcgccgcctgacagattcgacacaatttattgtaattacccacagacgtggtacaatggaagaagcagatatgctctacggcgtgaccatgcaggagcagggcgtttccaaaatgctgatgctcaatctggctgaggcggaaaaacggctcaaaaataccattaagtaatggaaaattgagaatggaaaatggagaattgcggcaatggatatgcgaagcgaaaaatatccgtaccggctggatgtggaaagacgattgccgaacggctctcttacgacagacggctatgcggcacggcatccggtcgagtttcggcactggggacatgcgcgcggctatgttctctggggtgagcggattgaccgcacagactgggagaactggcgtatcaactactacggtaaataattactgattcctgatttgcaagggcaataccgcataattgaacaagagtgatttgcgagtgaattttgcgtactgacgaggcacagttttgcggtaatacttgatgtattaccgtgaaacttcggcagcgcggacggaactcgcgcaaggaaccgaagccaaagtcaggacacaaaatttccgcaaagcaccgcggcagtgcgaccggagcctgcacaaggagccgccgctttaattgtgcggtgttgcccaagataaccataaggagataagcatgggattttttgataaaattaagcagggcttaaagaaaacatcggatgcggtaaaccactcgctggacagcgtgttcgcggcatttgtcaaggtggatgatgatctgctcgaggaactggaagaagcactcatcctgtcggacgtcggtgcatccacggcggcgaagatcgttgctgaggtcgaaaagcgcgccaagctgcgtaagaccaccacggcggacgagttgcgcgatctgctccgcgaggtgctgaccgacaatatgctcgacaaccagccgctgaatacggacggcaagccggcggtcattctggtaatcggcgtcaacggtgtcggcaagacgacctcgatcggcaagctggcggcccgctatgtcaatgagggtaaaaaggttatgctgtcggcggcggataccttccgcgcagcggcagctgaccagctcgaaatctgggctaaacgtgccggtgcggacatcgttcgccacggcgagggcgcagacccggcggctgttgtgttcgactccatctcggcggccaaggcacgcggcagcgatatcatcatcgtggatacggcaggccgtctgcacaacaaggccaacctgatgaacgaactggcgaagatcgaccgcgttatctcccgtgagctgccggatgcgtcgcgcgaaacgctgctcgtgctggatgcgaccaccggtcagaatgcggttcatcaggctgaggagttcaacaaggctgccgagctgaccggcattattctcaccaagctggacggcaccgcaaagggcggcatcgtgatcgccatttcggcaggactgggtgttccagtcaagctggtcggcgttggcgagggcattgacgatctgatcgactttgaccgtgcggcattcctggaggccatcctgccgccggttcacgaaaacacagaaaacgatgaggaacagaccgaggaggacgaaaatgcagagacctgacggaagaaccaagggcgcaatgcgtccggtgaagattaccactgattacacgatgtacgcggaaggctcggtgctggtcgagatgggcaacaccaaggtcatctgcaccgcatcggtcgaggaaaaggtaccgccgttcctcgagggcaagggcctcggctgggtaaccgccgagtatgcgatgctcccgcgtgcgaccaatacccgcaaaaaacgcgatatcaagtcgctcaagctggacggccgctcgagtgagatccagcgtctgatcggccgtgcgctgcgtgcggtcgttgaccgcgaagcactcggtgagcgccagatcacgattgactgcgatgttattcaggcggacggcggcacgcgctgcgcgtccatcaccggcggatttgttgcactgtggcttgcatgcaaaaagctgctggccgatggcgtgatcgagaaaatgccgctcaccgcacaggttgcagccgtttcggtcggcatttttgaggacgaagctgtgctcgacctcaactacgccgaggacagccatgccatcgtggactgcaacgtggttatgacgagcaagggtgagttcatcgaggtgcagggcaccggcgagggccgtccgtttacggataccgagctgcgcaagctgctcggactcggcaagcgcggctgcctgacgctgtgccgcaagcaggccaaggtgatgggggaaagtctgtaatgcagtttgtacttgcttcccataacaagaaaaagctggcagagctgtccgctatcgtgagcagcctcggcattgaaatcatcccgctgccggagggtgcccccgaacccgaggaaaacggcaaaaccttcgaggaaaacgcgctcatcaaggcgaaatccgccgcagagttcaccggtctgcccgctctcgcggacgacagcggcctgtgcgtggatgcgttggacggtgctcccggtatctactccgcgcgctactgcgagggtacggacgaggaccgcaatgcctttttgctgaaaaatatgcaggataaggaaaaccgtgcctgccgttttgtgtgcgcgatcgcgtgtgtgctcgcggacggcgaaacgctcaccgtgcgcggtgaatgcgagggcacactgctccgcgagaaccacggcgcaggtggcttcggctacgacccgctgttctatgtcgagaaatacggctgtaccttcggcgaactgccggcagaagtcaagaatacaatctctcatcgggcaaatgctttgaataaattgaaagccatactaaaagataaagtgaattgaaaatggagaatggataatggaaaatgtcgctatccttgcgcgggttctgtccgcgctgcgacgaggtgcggcacgtagtgccgaataaaataatcgcgcaaggcgcgataccataattctccattctccattctcaatttttcattaaaacataaggagaaatataatgcttaacacaaaacaacgcgcacagcttcgtgcaatggcaaacccgctggcggtcacgctgatcatcggcaaggaaggcgtaaccgacgcggtagaacgcgagctggacgcgctgctcgaatcccacgagctggtcaagggcaaggtgctcgagagtgcgatgctgacgccgcgcacggtatccgaggcgctctgcgaggccaccggcgcggacgctgtacagtgcatcggctccaagtttgtgctgtaccgccagtccagcgatgaggacaagcgcaagatcgttctggtaaaatgaggacgggaattctcggcggcacattcaatccgccgcatctgggacatctgcatgcggcggaactcgcgtaccgtgcgctgaacttagatcgggtgctgttcattccgaccaatattccgccgcacaaggtactgccggagaacaccgcgtccgcagaggaccggtgcgagatggtgcgccgcctgacggcagaaaaaacgtgggcgatgcttgacactatagagattgaccgcggcggcgcaagctacacggtggacacgctccgcgcgcttcatgcacgcggcgagaccgacctgcacctgatcgtcggcacggatatgctgctctcgttcgataaaatctggcgtgcgccggacgagatcgcgcggctggcttcgcttgctgtctgcgcccgcgaaaacgaggactgggacgcgctgcgtgaaaaggcggcggcgctcaaggactcgctcggtgcaaccgtagagctggtgcagggcgacagcctgaccatttcctcgaccgagctgcggcagggcggtgcactgcgatgctatacaccggaatcggtcgcggattacatcgaagaacgtcatctgtacggctactaagcctgtatcatgcaggtttaacagataaatacaactttggaacggctcacggtccgttcctccttgtcggcaaaactgtagttttgcggcaggaattgctgagaaaggcggggaaaagttatgttatgtaatgaagaaatgcgtaaaagtatcctttccagactgcagggctaccgctatgagcactcgctcggcgtggagcgtgcggcgatcatgctggcagaaaagtacggcgaggacccggaaaaagcgggtactgcaggcattctgcatgacataacaaaatatctttctccgcaagaacagttgaatttatgcgggaaatacggtataataccctgtaccgtcgaaaaaagcgagccgaaaatgctgcacggaaagacggcggcagccatcgcgcgggccgaataccacatgcccgaggatatctgcgatgccatcgcctgccacaccaccggcaagaaccatatgacgctgcttgacaagatcttgtatctggcggattacatcgaagaaactcgtgattttcccggcgtggacaaggcgcgtgagctggcgcagatcgacatcgacagtgccctgctctactgctatgaccagacgctgaccgagctagtcgcacgcggaaaactcatccacagcgataccattgccgcttataatgatatgattcggcagggtgtcagctggcgggacaagtaaaatggaggcaggaatcgtttgaaactattcggaggaagcggtgacaggaaaaaccgcaacggagacagcactccggcacaggctcccgcacagcaggcagcgcccaagccggaagggaaccaccagccgatctcggcgcccaagccgggcggcaaaaagggaaaggctccgaaggagaaaaaaaagctgacacccagacagaagggcaagcgcattgccatcgttatggcggttgtgttggtgctgttcgcgtgcgcagcagctgcagcggtgtggttcgttcgttcgccgcaggcgacgatcaaggacaaggaaaacggcgataaggtcgatgtgagcagcctgctcaactcgggcacccgcattgacgatgtgtttacgttcgtggtcggcgcagttgatgaggacgaaacacgaacagacgctttgatggtcgcaaccatggataccaaagacaagaccatcaacgtcatgaacatcccgcgcgacaccatgtgcaacaacacggcaaccggcgcgagcaagaagatcaacgcagcctacggcatggataccggcggcaagggcggcaacatcgagcagacgagcaaggaaatcgagcgtctgatgggcttccggccggataaatacgttatcgtcaactttgacggcattgcagccatcgtggatgcgatcggcggcgtggattatgacgtgccgttcgatatgaagtacgatgatccgtcgcagaatctgcacatcgacctgaaaaaaggccagcagcatctggacggcaagcagaccgtcggcttcctgcgctggagacacaacaacgattacaccgtacagtataccaacggcgatgaaggccgtgtagagaatcagcagaagttcctcaaggcgctggcaggtcaggtgctgcagatcaagaatgtgaccaagatccgctcgatcgcagaggccgtgttcaagaacgtcaagaccgacttcagcgccggcgagctgctgtggatgggcatgcaggccatgcagatcgacaacagcagcattcagttctttacactgcccggctacggcaagatgagcacggcgggcacttcggtgcagtattcgttcttcttcccgtattacgaccagacgctggaactggtaaacaagtatttcaacccctacgaggagccgatctccaagctggacatcgtcggcggaccggataccactacctactcgggcggctatgtaagctcgggcgaggaaaataatgtatggggtgacacctccggctcgtacgattacagcgaggattattacgaagaaccggattacagctacgatgagccatcctacgacaacagcggctcggacggcgattattcggataacaatgactactcgggcggcgacagcggcggagactattccggcggcgacaacggcagcggctccggtgaggagagcggcggcgattacaccgacggcggcggagaggacagcggtgcttcctccggcggagacgatggcggaacatacgatcccgaggcataagaaaggcaatataccataatcggcagaaaggcaaacccttttctgccgcacaaaaggagtttatactttgactgcaaaagaaactgtaaaggcgatctgcgaagcgctgatcgagaaaaaggctcagggcattgaggtgctgcatgttgagcgcctgaccgagctgaccgagtatttcgtcatctgctctgcgtcctccactacgcaggttaaggcactggcggacaatgtagagtggcacctgaagtatgaccatgacgagatgccgcaccacaccgagggctatgaatccgcacagtggatgctgctggactacggctgcgctgtactgcatgtattcatgccggaggcacgcaagttctacaatctggagaacctgtggaaggacggcacgccggtaacgcttgaagagctgggcatcgaggacaagtaaaataccgacatgcggcggcgccgggaacgacgtccgccgcgttgtcgcgctcaaaatccaaaactcactttagggggagaatccgttgaagtacgatcataaacaagtagaaaagaaatggcaggacatctgggacgagaagcagtgcttccatgccgagaatgactcggacaaggagaagttctacgcgctcgtagagttcccgtatccgtccggtcagggtctgcatgtaggtcatccgcgctcctacaccgcgctggatatcgttgcgcgcaaaaagcgcatgcagggctacaacgtgctgtatccgatgggctgggatgcattcggtctgccgactgagaactttgccatcaagaaccatgttcatccggcagaggttaccaagaagaacatcgcacgcttcaagagccagctcaagagccttggtctgtcgttcgactggtcgcgtgagatcaataccaccgacccgagctactacaagtggacccagtggattttcctgcagctgttcaagaagggcctggcctacaagaaggaaatgagcgtaaactggtgcacctcctgcaagtgcgttctggcgaacgaggaggttgtcaacggcgtttgtgagcgctgcggcagcgaggtcgttcacaagaccaagagccagtggatgctcgccatcaccaagtacgcacagcgcctgatcgacgatctggatgatgtggactacatcgagcgcgttaagattcagcagcgcaactggatcggccgttccaccggcgctgaggtcgatttcaagaccaccgagggcgacacgctgaccgtttacaccacccgtccggacaccctgttcggcgcgacctacatggtaatctctccggagcacccgatgatcgagaagtgggcggacaagctgaacaacattgaggacgttcgcgcataccgtgaggaggctgcccgcaagtccgacttcgagcgtaccgagctgaacaaggacaagaccggcgttaagctggacggcgttgccgcaattaacccggtaaacggcaagcagatcccgatcttcgtttccgactatgttctgatgggctacggcaccggtgccatcatggctgttccggcgcacgatgaccgcgactgggagtttgcaaagaagttcggctgtgagatcatcgaggttgtttccggcggcgaggatgtccagaaggctgcgttcaccgcaaaggacgaaaccggcattctggtaaattccgatttcctgaacggcaagaccgttaaggacgctatcccggctatgatcgagtggctgggtgaaaagggcatcggccatgccaaggtgcagtacaagctgcgtgactgggtattctcccgtcagcgttactggggcgagccgattccgatcgtcaagtgcgacaagtgcggctatgtggctctgccggaggatcagctgccgcttgagctgccgaacgtaaccagctacgagccgaccgacaacggcgagtctccgctggcgcacatgaccgactgggtaaacaccacctgtccgtgctgcggtggtccggcaaagcgcgagaccgataccatgccgcagtgggccggttcctcctggtacttcctgcgctatatggacccgcacaacgacaaggcgcttgcctcgccggaagcactgaaatactggtctccggttgactggtacaacggcggcatggagcacaccacgctgcatctgctgtacagccgtttctggcataagttcctgtatgacatcggcgtagtgccgaccaaggagccgtatgcaaagcgcaccagccacggcatgatcctcggcgagaacggcgagaagatgtccaagagccgtggcaacgtcgtcaacccggacgagatcgttgacacctacggcgcagacaccatgcgtctgtacgagatgttcatcggtgactttgagaaggctgctccgtggagcccgaagtccatcaagggctgccgccgcttccttgagcgcgtatgggcactggctgacaaggtgcaggacggcgacacctactccgagcagcacgaggtgctcatgaaccgtaccatcaagaaggtgggcgaggacgcagacaacctcaaggccaacaccgctatcgcagcgctgatgaccatgctcaacgagttctacgacaagggcgtaaacaaggctgagtacaagaccttcctggcgctgctcaatccgtttgcaccgcatatcaccgaggagctgtggcagcagctcggcgagaccggtctgctctccgtagcaccgtggccgacctacgacgaggccaagaccgtcgagagcacggtagagctggccgtacaggtaaacggcaagctgaagtgcaccattaagctggcagtcgacgcggacaagcagactgcgatcgataccgcaatggcagaggaaaaggtacagcacgccatcgagggcaagcagatcgtaaagcagatcgttattccgggcaagatcgtaaaccttgtcgtaaagtaagaaggaatgccggatttccgcgtcaaaaagaaaaaatcgaaaactacgggaaaaagtagttgacattgacgcggaaattcgatataatatccttacggttttgtgtatggatgtatacaaactgtgctaagcgatccccatgaggggaacgtgcggagggagggaaaactgtgtcggagatccgcatcaaggaaaatgagtctattgacagcgcactgcgtcgcttcaagcgttcgtgtgccaaggcgggtacgctttccgagctccgcaagcgtgagcattatgaaagcccgagcgtaaagcgccgcaagaagtctgaggctgcacgcgcaaagaagaagaagttccgctaaaatagaatttccagagagcagatggttaaacgtctgctcttttcttttgctttgcggcagcctttttcagcaccggctgaccggggaacctgaactgcgcaggcggttcattctttccgggcggcagtcttttcagcatcggctgagcgggggacacgaactgccgcaggcgggttcgcccctaacgggcggggggttttcgctgaacctcagcggggggattcgccgcgccccgcggcggggcaagagggtagacaccaaggtttctaccctcttaactcccacttccttttatttcttagtctggcgcagattgccgacatgtgaccgctgcgaaaataggggaacggcagaggattttttcttccgtatctttcgcaatctattcgcagggtcggatacattactgctacacagaccggctactctccgcaggcgcaacatactcgtgttgcgcaactcgtaagtctggagataacagacggcacctgcgaatttatgcgtttgatacaatttatcttcggagaaactgtctgtaacaacgcgctcacgaattgcgcggcactgctatgccgcgccggcgtagagttgcccatatgtgtagcagtacgctgtctgtgaactgcgaaaaggcggagaaagacatgctgcggtaacccgactgccgtactccttttcgaagcggtcacatataggaaatctgcgccggattaggaagcaaggggaaaggtaggagttcaaagaggaagggaaaccgcaggtgtcccttcctttttgcccccacggcgggcgccgcactctcccgcgctccgcagagcgcaactcccccgctgaggttcagcggaaaactctccgcccgtcaggggcgaacccgctaacgcagttcgagtaccctgctcagccggtgctgaaaaaggtgccgcccgtcagggacgaaccagctgacgcagttcgtgtgccccagtcagccggtgcagaaaaaggtgccgcccgttagggtgaaccgcctgcgcggttcaagtaccccgctcagccggtgcagaaaaaggtgccgcccgttaggggcgaacacgcctgcggcagttcgcgcgccctgttcagccggtgctgaattcacaaatcgaaatttccggcatttccgccgataactctgcatacacctgtataatggaggacaaaattatgaacataaccgtatatctgggtgcaaacgagggccgtgagcctgccctcaaaaccgccgtgtgcgagcttggcacatggattggcgagcatggccatacactggtctacggcggctcacgggtcggtctgatgggtgcggtcgcggcgagcacactggccgcaggcggcaaggtaatcggcgtagagccgcgcttttttatcgagcaggagctgcagctggacggtttgaccgagctgatcgtcaccgaggatatgaccgatcgcaaaaccaaaatgatcgagcttggagacgcgttcatcgcctttccgggcggtacgggcacgctcgaggagatcgccgaggtgatgagcaagctggcgctgaaccatctggatgcaccgtgcattttctataatctcaacggctattacgaccatatgaaggcactgctcgaccacatgatcgagatggagctgtccaccaaagaacggcagaagaaaatctattttgcggatactctggaagaagtgacggctctgctgaattaaaaatggagaatggtaaatggatacgttcattttccattctcaattttcaatttggatacggtatgtttacggtttcttcaaactttctacatactttagacatgggattcctgtatcctgtaatcacagcaggggaacagcaagctgagtgctaaaaacagcttgccatcccttttgaaatagatacttcataggaaatctttttctccgactgtgtgagcagtcaatccctcaaaaatctgtctggccctgtgggacggaataccgcgcaggctcccggacagtccaaaaacaagaggtgcaagacacccattgggcaataccgcataatttccgcaaagcaccgcggcagcgcgaccgaagcctgcgcaagaagccgctgctttaattgcgcggtgttgccccatacaacgcgctttcagcagaaactgagagcgcgcattttttgcgttcggacaaaatagggggcaaggcagtgatttgtctggtgttatgatttctgtggattttgaaaaaacagaacaattgttctgctttattgacataaacaatgatatggtgtaaaattaatataaatgactattttatatctgaacagatataataaagtaagtaaaacttcgaaaattgggagttaaagtatatatgagcaaagcaaagccgtcttacggcaatgaaagcatctcctcgctgaagggcgcggaccgtgtgcgcaagcgcccgggcgttatcttcggctcggacggactggagggctgcgagcacgcggtctttgagatcctgtccaactcgatcgacgaggcgcgagagggccacggcaccgagatcgtcaccacgcgctatgcggacggctcgatcgaagtcgctgaccatggccgcggtatcccgatcgaatggaacgaaaacgagcagcgctacaactgggagctggtcttctgcgagctgtacgcaggcggcaagtataaaaacgacaccggcgaaaactatgagttttcacttggtctcaacggtctcggtacctgcgcgacgcagtattcctcggagtatatggacgtcaccgttatccgtgacggcttcgagtacggcctgcactttgaaaagggcgaaaacaagaccggcaccaaggaaggctacaccaagaaggcgacgaacgcgcgcaaaaccggcacgaccatccgctggaagcccgatctggaggtattcacggatatcaacatccctgtggattattatctggatacgctcaagcggcaggcggttgtcaacagccacatcaagtttgtgctgaaaaatcaggtgggcagcaggtacgagaccaccgaatttctttatcagaacggcattgttgactatgtgaccgagctggcaggcgaaaatccgctgacctcggtgcagttcctcgagggcgaacgacgcggacgcgaccgcgccgacaaggccgagtacaaggtgaagctgtcgtgcgcgttctgcttctcctcggcggtgtcgcagatcgagtactaccacaactcctcgtggctggagcacggcggtgcaccggacaaggccgttcgctcggcgttcgtgtccgccatcgacgcgtatctcaagcagaacaacaagtacaacaagagcgagagcaaggtcacttatcaggatattttcgacagcctcgtgcttgtcaccaactgcttctccacccagacctcctacgagaaccagaccaagaaggccatcaccaacaagttcatccaggaggccatgaccgagttcctcaaggaaggactcgagatctactttatcgagaacaaggccgaggcagacaagatcgccgagcagatactcatcaataagcgcagtcgcgaacaggcggaaaaggcgcgtctgaatatcaaaaagaagctgtccggcaatattgacctcgctaaccgtgtgcagaagttcgtggactgccgcaccaaggatgcgtcccgccgtgagctgtatatcgtcgagggcgattccgcactcggttcggtaaaacagggccgcgacagtgaatttcaggccatcatgccggtgcgcggcaagatcctcaactgcctgaaagccgattacgacaagattttcaagaatgatattatcaccgaccttctcaaagtcctcggctgcggtgtcgaggtgcgcggcaaggcggcaaaggatttgtctgcgttcgacctcgaaaacctgcgctggcaccgtatcatcatctgcaccgatgccgatgtggacggctttcagatccgcacgctcattctgaccatgctgtatcgtctggtgccgacgctcatcgaacagggctacgtctatattgcggagtcgccgctgtatgagatcacctaccgtgacaagagctattttgcgttcgatgagagcgaaaaagcggctatcctcaaaaagctggagggcaaaaagattctcatccagcgctccaagggtctcggcgagaaccagcccgaaatgatgtgggagaccaccatgaaccccgaaaaccgccgtctgatccgtattacgccggatgaagcggctgccacgagcgaaatgttcgacctgctgctcggcgacaaccttgccggacgcaaggagtatatcgccgagaacggcgcggattatctcgaactggcggatatttcgtaagggcaaaaatgggggatagcaacatgcggattcggcaaatggacggcctgcgggcagttgcggcgctggcagtggtgatgatacacgtttcggcaggccgcatgaacccggtcggtgtatcctgtaatcagacagcgcggtttgccgtgccgctgtttatcatgctgtccggctacggacacatgcactcgtggctgcagcatagcggtcagtctgcggtgcagacggcaaagcggcggctgaaacgcgtgctgccggcgtatctggtctggtcggtcctttaccttgcggtggatgccgtgttcggcaaaccgcatgcacatccgatcaaaaacattctgacaggcggcagttacgtccacctgtattacatattcatactggtgcagctgatcctgctcagcgagctgttctgccgtgcggtagagcggcatccggcggtgacgctgctcctgtccgcaggcctgaccttcggtatggagatggtcctttacctactgaccgtcggtcagctgcagtggcagtttccggtggcgccgatcggtctgttcgtgtgctggccgctgttctacaacatcggtgcatggctggcgaaatccggcctgagcgaccgcttgcgtctgcgcgtctgtctgccgctgtgggcgctttcggcggtgctggtgctgctggcggaagagcattctgcggcagcctataaaatgggtctgcggcctgacacaacggtttacacgctgctgacatgagccgtgctgtggtcgctgttcagcaggctgccggagattccgaagccgctgcagtttatcgcgcggcattcgttcggactgtatttggcacatccgctggtgctgcgcctgtggaacgcgtgggcggtacggcagacaccggttatctatctgcacctgtggcagatgtttgcgctggcgtttgcaggcggactggcgattgcggtcacactgtcttatctgccgttcggcgagtatctgggcggcgcaaaacgtacaaagaaaatcctgcaaaggagagcataatggcaaaaaagaaaaccgacgaacccaaagtatataaagaacatccctcggtcgatcagcgcatcacggacacactgcgtgagaactacatgccgtacgcgatgagcgttatcgtgtcccgcgcgatcccggagattgacggcttcaagccgtcccaccgcaagctgctgtacaccatgtacaagatgggcctgctgaacggcaatcgcaccaaatccgccaacatcgtgggtcagaccatgaagctgaacccacacggtgacgcagcgatttacgagaccatggtgcgcctgacacgcggcaacgaggcgcttctcatgccgtttgtggacagcaagggcaacttcggcaaggtatactcgcgcgatatggcatacgccgcgccgcgttataccgaggccaagctggatgcgttctgtgccgagctgttccgcgatatcgacaccgacgcagtggattttgtggataactatgacggcgagatgaaggagccgacgctgctgccgacaacctacccgaacattctcgtgtccgcgaataccggcattgcggtcggcatggcgtccaatttctgcggctttaacctcgcggaagtctgccgcacgaccatcgagcttatcaaaaatcccgagcacgacatcctttccacgctgcccgcgccggacttcacgaccggcggcgacctcatctacgatgaggcggaaatgcgtgccatctaccgcaccggacgcggctcgttcaaggtgcgcgcaaaatgggcgtacaacaagaaggacaacctgatcgagatcacggagattccgtacacgaccaccatcgaggccatcatcgacaagatcgccgagctggtcaagaacggcaaggtgcgcgagattgccgatgtgcgcgacgagaccgacctttccggtctgaagatcgccatcgacctcaagcgcggcaccgacccggaaaagctgatggccaagctgatgaagatgactactctgcaggacagcttctcctgcaacttcaacgtgctgattgcaggcatgccgcgcgtgctcggcgtagccgaactgctcgatgagtggacggcgtggcgcaccgaatgcgttcgccgccgtgtgttctttgacctcaacaagaagaaggacaagctgcatctgctgctcggtctgcgtaaaatcctgctcgatatcgacaaggcgattaaaatcatccgcgagaccgaagaggacgcaaatgttatcccgaacctgatggaaggcttcggcatcgacaaaatccaggccgaatttattgcggatatccgcctgcgcaacatcaacaaggagtatatcctgaagcgcacgcaggagaccgaagcactcgaaaatgagattaaaaagctggaggaaatcgtcaaatccaaggcgaagatccgcaatatcatcatcaaggagctggagcagatcatcaagaagtacccgtccgagcgccgcacgcgcatcatcactgcggacaacgtgcagcagttcgacgaggaggaccacatcgaggattatccggtgctgctgttcctcacccgcgagggctacttcaagaagattacgccgcagtcgtggcgcatgtcgcaggaccataagctcaaagagggcgatgaggtgttctggacggctgaggcgaccaataagaacgaaattatctttttcaccaatatgcagcaggcgtacaaggcgcacctgtacgattttgaggacagcaaggcgtctgtgctcggtgattaccttgcgtccaagctggaaatggacgagggcgaaacgccggtttatgccgtcctgccgggtgactacaagggcagtatggtcgttgtgttcaaaaacggcaaggcagcccggttttcgatggaatccttcgagaccaagaccaaccgacgccgcctgaccggcgcgtactcggataaggcaccggctgtggcgttcttccacccaatcgagaaggagagcgaggtcaccatgttctcgactgccaaccgtgcgctcacgttccgcgcgagcatgctcgatgtcaagacaacccgttccacgcagggtgtgcagaccatggtgctgcgcggcaagcataccattacgcgggcgtgccgcaccgaggacgccgcgctcagcgataacgcgcgctaccgctgccgcagtattccgtccatcggcgcattgcttaccgatgaggatctgccggataagcagctcaaattgctttaatgcgaaacgcagagggtttcctctgcgttttttctctgcaccgattctgcgggggacacgaaccgcgtaagcgtgttcgtccctaacgggcgggagcgtgccgcgccccgcggcggggagttgcgctgacgccgcgcgggcgcacaagagggtagacacctgcggtttccaccctcttgtgaattacccctttcccttagagggtctggcgcagattaccgacatgtgaccgctgcgaaaaggagtacggcagaggattttttctaccgtaggggagcacagtgtgctcccatgccgagacatattcgcagcgtcagataaattactgctacacatgtgatttcatctaagcaggcgcgacatacccgtgtcgcgcaattctttaacgtgttataccggaaggcacctgcgaatgtaggcgtttggtacaatttatcttcgtaggtgctgtctatcataacgcgctatcgaattgtgcggcactgttatgccgcacccagcgtagagttgcccatatgtgtagcagtacggtatctgatactgcgaacaggttgagaaagacacggaagaaaaaatcctctgccgtccccctctttcgtagcggtcacatgtcggcaatctgcgccagattaggaagcaagggaaaggtaggagttcaaagaggaaggaaaaccgtaggttgtccttcctttttgcccccgcggcgggcgccgcgacgttcccgccgtccgcagacggcgaatcccccgctgaggtttagcgaaaaactccccgcccgttaggggcgaacccgctaacgcagttcgtgtgccccggtcagccggtgcagagaaaggagccgcccgtcagggcgaacacgctgacgcagttcgcgcaccccgctcagccggtgctgaaaaaactgccgcccggacagggtgaacctcctgcgcggttcaggtgccccaatcgcccggtgcagaaaaaaggagatgcccggacagggcgtagcgcatacgcgcctcgtgtgcaccagaaggccggtgcaacgaaaaagagtgccgcacacggacacatgtccacccatgaagatcaaatatttttacgctttacactataaaagcgatgtgctataatacagggtataagagcgaaaaaacgaatgtagggagggatagaccatgaatcgaaagttgaaggacgaggatatggacattctgttccgcggtattctcaagctgcagacggtcgaggattgctacgacttttttgaagatctgtgtacgatcgcggagctgcgggctatggtacagcgctttcaggtggcgcgcatgctggatgagggccgcatttacagtgacatcgtacaggagaccggcgcatccaccgcgacgatcagccgcgtgaacaagtgccttgtgtacggctcggacggctaccgcaagatgctcgaccggctcaaggaggacgaaacagcagaggagagccatgaatagttacgagactctgtcggaatactatgaccgcttcacggatgacgtgggctacgaggaatgggcagactttttcgagcgcctgtttgagcgggaaggcgtaaagccgtcgctggtgctcgatctggcgtgcggaaccggcagtctgacgcgcattctggcgcagcgcggctatgatatgatcggcgcggacgcatcgccggaaatgctcatgcaggcgctgcagaacacgctggactgcgagccgcgtccgctgctgctcaatcagcgcatggaggagctggatctgtacggcgcggtagacgcgtgcctgtgctgtctggacagcgtaaactacgtcactgagccggaagcactgcagaccgccttcgagcgcgtacacacgttcctcaatccggacggcctgttcgtattcgacatcaacacacccgagaaattcacccgcattgacggcgaaagctatgtccgcgaggacgacggcgtattctgcgtatggcaggcggcggtcgaggacggcctgtgcgcctaccagttcgatattttcgagcaggaggacgatgtgtggcaccgtgcgcaggaaacgcacgaggagcgcatctatgagcctgcacagctgaccgccatgctggagcaggccggctttaccgagatcaaaacctatggcgaccagtcctttgcgcccgtacagggcggcgaggaccgcatttactttacagcacgaaagagagattaacttatgagcgatacgttacttcgcgcgatcgcccgtgacgcgggcatccagatttgtgcagccagcacgaccgagctggtcgagcgtgcacacgaaatccacaataccacgccgctggctaccgcagccctcggacgaacgctgaccgcgactgccatcatgggcagccagctcaaggtcgaggacggctccgtgaccgtgcagatcaagggcaacggcccgctcggcgcgatcgtctgcgtcggtgattcggatggctatgtgcgcggctatctgcaggacccggctgtcgatctgccgctgcgtgcggacggcaagctgaatgtaggcggcggtgtcggccgcggctatctgatggtgattaaggacattggcctgaaggacccgatcacgggcacggttgcactcgtcaacggcgagattgcagaggatctgacccgctacttcgcggagagtgagcagatcccgtctgcgtgcgcgctcggcgtgctcgtggataccgactgctcggtcaagtgcgccggcggctggctcgtgcagcttatgccgggcgtgaaggattccgacattgacaagctggaggccaatctggcaaagctggagagcatgactgctatgctcgataagggcatgagcctcgaggacatcatccgcgcggtgctcgatggctttgaggtagattttctgcagaccagtgaaatcggttaccgctgtgcgtgcagccgtgaaaaagtagagcgcgccctgatcagcatgggaaaaaacgaactttgcaagatggcggaagaacaggaaaatagtgaggtaacctgccagttttgcgataaaatctatcgtttcagccgcgcagagttgcaggaacttttaacacacgcaacgaaataaaaagaaaataaaaaaactttgaaaaaagtgttgacatttgggcacaggttctgtataataaacatcgtcgctgagagatacgaacgaaaacgaaacagcgacgacggcctggcccggtagctcagttggttagagcgctagcctgtcacgctagaggccgtgggttcaagtcccatccgggtcgccattcttcaatcggaaacgattggagaaatatgcctctgtagctcagtcggtagagcaggggactgaaaatccccgtgtcggtggttcgattccgcccggaggcaccattttttcaatgagtgccgtggcactcattgaaaaaataatacctccaagccaaggaatcgaaagctggctcttggaaatatgccggtggcatatttcaaccagcgtggcttttgccgcagcaaaagcgattccgcccggagaggtagcgtcggagcggcaagtaacccgtcttcgagtcaaagaatcgcgttagcgcgaaaaaccaaatatgcggctgtagctcatctggtagagcgccaccttgccaaggtggaggtagcgagttcgagcctcgtcagccgctccacatggtaccatagccaagcggtaaggcgtgggactgcaactccctgatccccagttcgattctgggtggtacctccaaaagactgatgtgaaaacatcagtctttttgttttgcacgcaatcacgcagattcaggtaaaggttgacaaatatagcagactgtgttatattccacctatggatgcactacggtgtccatgcaataaaaggaggaatttaatatgacactcagaaagcgactgatcgcgctgagcatggcggcggcgtgcgcggcaacggcattcgccggtgcagcgtttactgaccagagcgacattaaggtggacgattatgtgctcaccagaatgcaggagctgaacatcatcaagggttacgaggacggctcgttcaagccgaataagatcgttacccgtgcagagatggcgaaaatgatttacgttctgcgtaatggtcatgacgacgcaagtttatataccaataagttcgacagtgcgttcacggacatcaacgacagctgggccaaggtgtatattgagtattgcgaggctaatcattttgttcgcggccggacgaccacaaaatattgcccgaatgagccagtcacaacggttgaagcggcaaaaatgctgttgcttgagctgcgttacagtccacagtttctcgccggacgggaatggaaagacacggtaatggaaaaagcggaaaacatcggtctgctgaacggtgttgcggttggacaggacgatcctctgccgcgtcagtacgctgcacagatggtttacactgcacgcaacaccccgtaaagatagcaaagaaaagtccctcaaccgagggactttttttcatcttcataaaatctaaagaaattccctgcggaaaacaacagaaacctgtggtaagatagaagtaacgaaagggggaagggaaaatggaaaagctgactgttctggtggtggatgacgaccgcgagatcgtggaaagcattgcgatattcctgcaggcggacggctatctggtacgcaaggcgtacaacggtctggaggcgctcgatatcgtcatgaccgagaacgtacaccttatcatccttgacattatgatgcctgagctggacggaatcaaaaccttattaaaggtaagagaaagcaaaaatctgccgatcatcctgctgtcggccaagagcgaggacgcggacaaaatcctcggactgaccgcgggtgcggatgattacattacaaagccgtttaacccgtccgagctggtcgcgcgcgtgaaaagccagctgcggcgctacacccagctgggcgcgatgcagataaaggaaacgcagattgccatccgcggactggtgctcgacaccgagagcaaaagcgtgacggtggacggcgaagccgttcgtcttacaccgcttgaatacaaaatactcgagctgctgtgccgtcacccgggcaaggtgttctccaccgaggagatttaccggcaggtgtggaatgacgatatcgtcagcgacaacgccatcgccgtccatgtgcggcacatccgcgaaaagatagagatcaacccgaaggagccgcgctacctcaaggtagtatggggcgtcggctacaagatcgaaaggagcgagtgagtatgaatatcaaggggatcttacgcagtacggcagcgaagctcatcgcgtttgcgggcattgtggggtgcttcgcaggcgcgctgtttctcaccgagaacacgataacagattttgccgcgaacggccttgaccaaatggtctatcgctttgagggtgattttgccgactcgtcctatatgcatcaacagctcggcataatgtgtgctgaaatggcgaatgcgtttgaagatggcatggacgcagcggaattcagcaggcagcatacggattttgcgggaaactatttcggccgtatgggcgataaaacggtcggcgatgacacgctgaccgaagccgcggcaaaaaattctgcgttttacatgattacacggccgggtggcaatgtgcagtccaacgtgggaatgtactacggctatccgcttgcggtttacgatgaggaaacggacagttacggctactacaccgaggaggatacggcagaggaaggctggaagttcaataagttccatccgtacccggagaacacgttactgctggtgcgctttacggacgcacaggctgcacccatcaaggccgagtgggaaacgcagaaaacgcagattaccggcgtgctccagcaggcgattgtgctgacgtgcattgcactggtgctgttcgtgtatctgttgtttgtcaccgggcgcaagccggaggacgaggacgtgcacctcgtcaccatcgaccgccttccggtggaagtgaacgtgctgtgcttctgggcggtgctcggcacggcaggcggactgaatctggcactgatgggtgaattgctgaacggcacaaacgatatgtcgatattgctcgtaccgtccatcctgtttttcgtcgcggcgtttgcgttcgcacttgaacttacgctgtcgcttgtgcgcgtaatcaagaaccgcagcttcgtcaagcagtgctggtcgattcgattcatcctctggtgctggcgaacctttattaaggtatgcaagtgcatccggcaaagtttcggaaaactgcgccgcatgctgttccgcgactacaaaacgcgcaacgttgtgctgctctttacggcgtattcgattgttctcgcgttccttgcggcggtgttcggcggagtgggcggctcgttttttgtcttcgtgctcggcgcggtctggttcctcgcggcaggttactttctcatcaaacgcatcaccggctttgaacgtatcgtggacgcactgcgccggctgcgggcgggcgacctcggcttcaagctgaccgacatgcctaagggtgtgttcgctgaaatggccgaggatattaactcgcttggtgacggcatgcaggcagcactgcagaacgaagtccgcgcggaacgcatgaaaagcgaactgattaccaacgtcagccacgatttgaaaacgccgctgaccagcatcctcaactattccgatctgctcggcaaaatggatttaacgccggaggaggcgaacgactacgcccgcattatccatcaaaagggtctgcggctcaagaatctgacgagcgacctgttcgatatctccaaggtgcagtcgggcgcagagcagatcatcagcgaacggctggatgcgtgcacgctcgcccggcaggcgctcgcggagcaggacaaggctgtgcaggagagcggcttgaccgtcaaagccgccattcccgagcgggagctgcccatttgggcggacggacgcaagctgtcccgcgtgctggagaatctcatcggcaactgcgtgaagtatgcgctcaagggcacgcgcgtgttcctctctgttgcagaggagaacggtcaggccattattgaactcaaaaacaccgccaactacgagatggactttgccgctgatgagatcaccgaacggtttgtccgcggtgacgcggcgcgctcgaccgagggcagcggcctgggtctcgccatcgcaaaaagctataccgaggcctgcggcggcacgttcgatgtctcggtggacggcgatcagtttaaggtgcgtatcggctttccggtgtacggtatgactgcaaagtaaattcttcgcggaaatggaaatcttatcttgtaatttggattacaaccgctataataggaattgacaagaaactgcgcgagcggtaagggcaataccgcagcttcaatcatgcggtattgcccaggacaagaaaggcggaaagaattatgattacgactgcaagcgaacatcaggtagataaggtagagcagatggctggcggcaagggacacgttatcatcgagcacctgctgggcgagaaggagctggacggcaagtgcggcctgtatgcaaaggtaaccatcgagccgaactgcacgctcggcttccacgagcaccacggcgagaccgagacctattacatcctgagcggtgaaggctcgtataacgacggtgagaagtcttatccggtcaaggccggcgacgtgaccttctgtccggacggcaccggtcatgcgctggataataccggcgataccgacctcgtgttcatggcactgatcattatgaagtaagcgcagagacgaaaagaacccgaagccttggctttgggttcttttttgtttgtaattggagaaatagagtgaagagtggagagaatatcagataaagcgtattcgcacagaaaaattcgcaggtgccgtccgtagccaccagacaaacgagttgcgcggcacgattagccgcgcctgcggagagtagaccgtatgtgtagcagtgcgttatgcgtgaactgcgaataggttgcgaaacaaacgcagcggtaacccgactgccgtacccattttcggagcggtcgccgctctctgattttcgccgggctaacaaataagggaaaggcaggagttcaaagaggaagggaaaccgcaggtgtcccttcctttttgtccccgccgcggacgcggcagtcttacgcgctccgcagagcgcagcttttcgctgaggttcagtgaaaatcttcccgcccggacagggcgtattgctaacgcaactcgcgtgccccacaagccggtacagaaaaggagatgcccggacagggtgaaccgcctgcgcggttcaggggtccagccaagtctctgtcgaaaaaatgggtgctcaaaaaatttcagacaaaacaaaacaggctcggataaaaccgagcctgctttgctgtgatcgggaggtgtgatccgatcacaaagaagaaaagagtaaaaaagaaaggaaaaaagagagatagtcaattagtaaagctgcgttttgcagcatttgtgctgtttttaagcactttctttgaacaattacagtatagcgtggttttcgtcgaaatgcaagaaaaaatgttcggcagtttgtatgaaaatactataaaatttttcggcgggaattgtgctttgcgttgagcgtgtgaaaaaccgccgtctctcaaaccgcttcgtttgtgaaaaatcgcatctggtggaaatctatcccttgacatattgctcatattgtatataatgagtatatacaataaaagagggaggaatggcatggacatcatagtatccaatatggacagcacgccgatctacgagcagatcacacgtcagatcaaggcgaaaatcctcggcggagagctgcagccgggggaggcgctgccgtctatgcgcctgctggcgaaggaactgcgcatcagcgttatcacgaccaagcgtgcgtatgaggagcttgagcgcgagggccttatcaccagccagaccggacgcggcagctttgttgcaccggtcagcagcgaacgtctgcgggaagcgcagcttcgcacggtggaagaccacctgacggacgctgtgcaggcggcaagactggccggactgtctgcggacgagttcgcagagctggcacggacactgtttgaggaggaaggattatgagagagaatgcactggagctgcacggcgtctgcaagaaatacggcggctttgcgctccgcaatgtgggatttaccctgccgagaggcacggtaatgggtttaataggagaaaacggtgccggaaagacaacgatcatcaaggcggtgttcgacctcatccggccggacagcggcgagattaccgtgctgggggaacacggctcgaatccgtccgtccgtgaaagaatcggcgtggtgctcgagaacggcggtttcccgagcgcgatgagcgccgtacaggtgagcacgctgctcggcagagcgtacaaaaactggaatgcggagcagtttgcgtcgtacattgaaaaattcggcattgaccgagaaaaggccatcagggactactccaagggcatgaaaaccaagctgaatatcgcggcagcgctgtcgcatgacgcggagctgctgctgcttgacgagccgacgagcggccttgacccggtcgtgcgggatgaggtgctcgatttgctgtacgacttcatgcaggacgaaaatcacgcgatcctgctgtccagccacatcacgagcgatttggacaaaatcgcggacgagatcaccttcatccacaagggcgaggtgctgctgagcgagccgagagacgagctgctcgacacctgcggtatactgcgctgcaccgccgatcagctggacgccctcgacccgtccgccgtgcgggcaaagcgcgtgggtgcattcggctgtgaggctctggtaagacgcgacggcgtaccggcgaactggtcggtcgagccggtcaacatcgaacagatcatgctgtttctgacgagaggggaggacgcaagatgaaagcaatgctgtatgcggactggatgaatctgcgccggtcgatgaaggcaatggtgatcgcaatagttgtaattgcgctggcctcgatcgtctccggaaacgggctgtcgtttgtgccggctatgctgtgcatgctgtcgcttatggtgcccgcaacgctcatgagcagcgattatgcctacggatgggataagctgagtctgtcgcttccggtctctcggcgcgatgtggtgagcagcaaatttgcaatcagcctgctggtcaatctgacggttgcggcactgagcatgatatgtattgcgggcatgaatgccttcggcggtgatgcaacggcagaggatgtgatgggcatgctggcctgtgaggcggtcgtccttgcgttgatgggtattgaaattgtactcgttttacagtttggtccggagcgcggtcggtatttactcattggcgtggtgtgggtgccgatcctcctgctgaccgttgtcaaaaagcatccggcattcaataaacttgtgcaggcggtcggcggcatggacagctggccagtcggacagcttgcggcgttcttcggtggactggtgattgtcggtgccatcgtgtacgcggtatgctggcgcatcggtgtgggcatttaccggaaaagagagctgtaaatgcataaaatccctctcgctccatataaataggaacgggagggacggaaaatgaagattttcagcttcgcactgcctctggcggtcggcggacttgcggcatggctgacgatgggcagcatgtcgcagtatgcggcgctggtgcagccgccgcttgcaccgccggcgtggatattccccattgcgtggacgattctctatgtgctcatgggctgggcgagcctgcgcgtgcggcagtccggctcgccggagcataagaacgcgctcgcgctgtattacacgcagcttgcggtgaatttcgtgtggccgctgctgttttttcgcgttggactgtacggaacggcgttctggtggttgattctgctgctggcgcttgtgcttgtcaccgcaagggcgttttaccgtattgacaagcaggcgggatggcttcttgtgccgtacttggcctggctgatatacgcggcgtatctcaatgccggtgtctggttcctgaataaataaaagggagcaaatcgtgtgatttgctccctttatgttactcatatctcagctttacgttttctgcattgcacagatcaacgtactccttcggcggttcgcagtcggtgatgaaggcggtcaggtccttgagatggcagaacgtgacgatcgcttccttgccgatcttggacgaatcgaccatgccgtagatgttatccgcgcggtggacaacggcacgcttgatctcggcttcaaggaaggtggtgttggtcatgcctgcggtcagcgacacgccggtcgcgcccatgaacgccttgttaatacgcatggaggacagcgcttcgatcgcggacaggccgacaaacgaatccgtagtcgggctgtaaatgccgccgagcgagataatattgaggttatcgtacttagaggcctcgctcagcgcaccgagcgagtgggtaatgatcgtaatccgcttttttgccacgagaaaccgcagcagacacagggtggtcgtgccggagtcgataaaaatggtatcaccgtccgcgacctcctcggcggccagacggccgatgagagacttgtcgatctggttaagacccgaacggatgggcgtcggcacggcacccgagggaaccgtagcggtcacgccgccgtataccttggtgatgtggccgcgctgctcaagctcgttcaggtcgcggcggatggtattcttggacacgccaaaaacctcgcacagctcgtcaatgctgacggtctcgcgcgagatgacatattgctctatcgaattgagacggctgactttcatattcacagctcccactatataatatatccgcccagtagtatccgaatgtatccacaatgttttctttagtttatcaaatttgtaaccagatgtccaccgctccgaagaatggtaaaacggcatgaatttggcgaaaaaggtcgaaaatacatgaaaaccctcggtgaaggacgatgaaaagtaattgaaatccgtaaaaccgcctctcgaaaataatttctggcagtgagcggggagaggagcggcaacccgtcttcgggggaagagatacgcagataaacggcagaaacagggcgggataccccttttgaaaatatatttttcaccgtttgcaagaggtttaccaacaaaataaatacatataaccagcagataaccaacaaattacctaattttactcgaaataaattggatattttttataaggcgtttgaatgaaattggaattttgcgaacaaatgcaggaatttcggttgaaatttcggcggtttggtgatacacttgtattcgtaaaacagtggcattgtgccgctgtacgctggaacctgttccgcggagagaaaattatattttgaattaggcaggtgtatgcaatgcagaaagcagaaaagatgcaggagcttcgtgtatttgctcaggaaatccgtgtggagaccctgaagaccgtcggttcgcttggcttcggccacgttccgggtgcaatgtccgttattgatgcgctggcagttctgtacggcgaagtaatgaaggttgatccgaagaacccgcattgggaagatcgtgactggtgcgtactgtccaagggccatgcaggtccggctatgtacgctaccctcggcctgaagggtttctacccggttgaggacgcttataccctcaatcagccgcacaccaacttcccgtcccataccgaccgtaccaagacccccggtgttgacctgacgaccggttctctcggtcagggcatgtccaccgctaccggtgctgctctgggcaacaagctcgacggccgcgacagccacgtattcgtattcgttggcgacggcgagtgcgatgagggtcaggtttgggaggctgctcagttcgcagctcactataagctggacaacctcgtttgcttcgtagacgacaacaagtaccagctcgacggtgctgttgacaaggttatgagccacggcaagggcatcggtgctaagttcgcagcatttggctggaacgttatcgagctgcaggacggcaatgacgtagagcagatctacgacgctgttcagctcgcttacgacaccaagggcgtaccgacttgcatcgtcctgaacaccgttaagggcctgggcgccacctttgctgaaggcactggcgcgcactcctctcagccgactaaggagcagtgggatgaagccattgctgctgctgagaagaagctcgctgagatcaaggcacagtaagggagggtattgaacatgagctttactttgattggcaagcacgagaaggattctcgtaacaaccgtgacggttacgttaccgctatgctggacctgatggagaaggacagcaaggttatgcatgttgactgcgacctcgagaactgcatcaataccggcaagctggctaaggctttcccggagcagaccgtaaacgcaggtatcgcagaggctaacgctatgggcgttgctgcaggtctggctgctaccggccgcaccgtattcatgcactccttcggctgcttcgcttcccgccgtgcatttgaccaggcattcatgtccgcagcttacgctaagctgccggtacacgttatcggttccgaccccggcgtatgcgctgcatacaacggcggtacccacatgccgttcgaggactgcgctctgtacatgtccgtaccggaagcagttgttatcgacccggttgacttcgctcagatcaactgcctgaccaagaagctggcagcatccggcaagttctcctacatgcgcatgatccgtaagggcttcaccaccgtttacggcgatggctctgacttcgagatcggcaagggcgttaccctgaaggaaggcaaggacgtagctatcatcgcttccggcatcatggtagacgaggcactgaaggctcaggagcagctggctgctgagggtatctctgccaaggttatcgatatgttcacctggaagccgctcgacgagcagctcatcctcgattccgctgctgagtgcggcgctatcgtaaccgctgagaaccatcaggtaaaggttggtctgggttctgctgttgctaacgttgttatcaagaacaacccggttccgatggagatggtaggcgttgaggatcgcttcggccaggtaggcgctgagtccttcctgcgcgaggagtacggtctgaccgctgctcacatcgtagaggctgctaagaaggctatcgctcgcaagaacggctaatcttcctcgcagatacgcgaagtaaaattgcatcgaaaagcgttccgacgtatgtcggaacgcttttttgtcgttacattgcacagaagcaaacgcagattttgcatggtctggaaatagacaatatcacccaaatctgctacactataagcacaacagtaaaaggaggaggtgtaccacatgaaaaaacggtacgcggcaggacttgcactggctcttgtggggattttgagcgtgtgcggacaaacggcggcagacaacacaatcagccttacaccggtggaggaaacgaccgcagaccagagtggcagactgattgagtataatttttccggccacaggagcgaagccgagggcgtattgtttggctgttatatatgggatggcagcacatggcagaaagatgaggatgccacgtttgggttgcgttgttcgacgacactgggcagcggcaagggcacgatcaaattcgagcgtgacggcgatgcggcgaatgcgaactataagattggaatggattcgccacagcttggcggatatgcacaggttatggattcgcccgagagaaacagtctgccgatggagggattgacggcaactgttgctgcatgggaggaacctgtcaatggcttggcagtcgacacggaaattccgttgctcgtgcgtgtgttccgcacggacggtacgatcattccggtatctattgatgcgttttcggaaccggaaaacagcaaagccgtacagaaaagtgtgtatgcggaagcgtacactgtaattttctgctatgaaatgtaaatgctgaaacggaggtgtaccacatgaaaaaacgatacgcagcaggactggcactggctcttgtggggattttgagcgggtgcggacaggcagagacacagccggcggataatacgatttccatcacgccggtggagcggaaaaccgatggaccgcagatggatatggcggtgaagtacgatttcgccggcaatcatgcggatgtaaacggaatggagttccggcgttacatctgggacggcagcgcatgggagaacgagggcgggacgtttaccgttaatttggataaagtcgaagaaaacgagggaacgattcggtttcagccggagagtgatgcactcaatgcggaatatatcgttatcattgatgcgcagacaccggaatcgggaaattctatacagtttacggaatctcctgcgctgagcggtctgccgacggagtggctgacctcggcggtggccatgcaggaggaaaagattgacgatctggcgctcgatgtagagattccgctgcttgtacgcacattccgtacagacggaacacagattctggtggcgattgacgcgttcgctgacccggaaaacagttcggcggtcaaatacagcagctatgcggaggcatatactgtgaaatttgtaaagaacgatactctataaaatgaatgccctgacctctcgtcagggcatttttctctttacgccaaccgcgaatttcactataatagagggagcagaaaggggagagaaccatgtcccaaacagacagcccgctgggcaccgcgccggtcggaaagctggtcttgcagcttgccataccggccatgctggcacagtttgtcaatattctatacagcgtggtcgatcgcatgtacgtcggccacattgcgggcgcgggcgatgcggcactggcgggtgtcggtgtgtgcgcgcctgtggtgacaatgattaccgccatcggtgcgctcatcggcttcggcggcggaccgctgatgagcatccgcatggggcggcgcgacatggacggcgcccgtcagatcattacgaacagcttctacctattgctggcgctgagcgtgctggcgaccgtgccgctgcttattttcaagcggcagatcctgttcaccttcggctgcagcgagctcctgtgggactacgcgcaggcgtactttacgacctatgtttccggcacggtgttcgcattactgagctacggactcaatcaaattacaatgagtcagggattttcgggtaccgcaatgcggtcggttatgctcggagcggccgtaaatatcgcacttgacccggtgttcatttttgcgctgcacatgggcgtgcgcggagccgctcttgcgaccgtactgtcgcaggcgtgctcgacggtgtatatcctgcgttttctgatgagtgacagagccgccgtccgcattacccgtcagccggtcaatttcggctggatgcgccgtattgtgcaggtcggtctgtcgcctgcgctcatcatcgcgctggataacgtgctgctcatctccatcaacgttatgctgcgcaaatacggcggcgcagacagcgatatgctcatcgcgtgtgccgccatcatgcagagcttcatgctcgtcatcaccatgccgctcggcggaattacggcgggcacgcagtccattctcggctataactacggcgcgtgcaacgaaaaacgcgtcatgaaggcgtttcggtgcattgtgctgctgtgcctcatgttctgcggcatcatgttcctgctcgcgcagacggtctcgggcgcttttgtcaaaatcttcaccaaagacccggcgtatattgatatggcggcgtatatgatccgcacctactcgctcggcgtgctcggactgaccatccagtacccgttcgtggacggcatgaccggcatgggccttgtcaaatggggactgacgttttccatgctccgcaagggcattttcctcgtcagcgtgttcgtcctgccgccgattttcggggcaacagccgttatgttttccgagccgctgtccgatgtcgtgtcggcggtgttctccggctgtgcggccatgttcctcttgccgaagctggtggcgaaacaatgctgcaagtagagcgaagagttgagagtgaagagcatgagaagtttaaccttcttcatgttgttacattacacataaaatctaaatcgtagggtgcgacaaggtgtacctttatgataatatgaaaaacggagaaacacgatgaatcattacgttcattccccatcctccattctccattctcaattacttcccgctctttgtacaaactacccctttacgaacgcatttctactctgtataataaggtaagatagaaaactctttccgtcgaacggaacaagaacgataacggaggaacagaacatggacgttaaggaacgcgcactgcaggcacacgaaaaatggggcggcaagattgaggtcgtggcccgctgtgaggtaaacagcaaggacgatctgtcgatcgcgtacacgccgggtgttgccgagccgtgcctcaagatcaaggacgatccgagcctgagctacaagtatacccgtcgtcataatctcgtggctgttatcacggacggcaccgcggtactcggtctgggtgatatcggtccgattgccggcatgccggtcatggagggcaagtgtgcgctgttcaaggcgttcgctgacgtggacgcgttcccgctctgtgtggcttccaaggatgtggacgagatcgtacgcaccattcagctgatctccggctcgttcggcggcattaacctcgaggatatcgcggctccgcgctgctttgagatcgagcgccgactcaaggaagtctgcgacattccggtattccacgacgaccagcacggcaccgctgtctgctgcggtgcggctctgctcaacgcctgccgcctgaccggccgcaaggtggatgagatcaagatggttgtcaacggctgcggcgcggctgctatcgccgttaccaagttcctgatgttcctcggcgtcaagcacattacgatggttgagcgcttcggcatcgtctgcgagggcgatgagcgcctcaacccggcacagcaggagatggccaaggtcaccaaccgcgagcacatgaccggcacgctggccgatgctgtcaagggtgcggatgtattcttcggcatgtccgctccgcaggtgcttactgccgagatggtctccaccatggcaaaggacccgatggtattcgctatggcaaatccggtgcccgaaatctggccggaggacgcaaagaagggcggcgctgccgttgtcggcaccggccgttcggactacccgaaccagatcaacaacgtgcttgcgttcccgggcattttccgcggcgcactcgatgttcgcgcaagcgacatcaacgaggagatgaagctggcagcggctaaggcgatcgcggcctgcgtttccgatgaggagctgaacgcggagtacatcatgccgatggccttcgacaaaaaggtcatccgttcggtagccgatgccgttgcacaggctgcccgcgattccggcgtggcccgcatttaaggagcagttttcgcgctccttgagcatcgtcgagctgaacagacgaaaagttacaaataagccaaaatcagccgtgcgggagcaatctcgcacgttttttgcacaaaaagtgcgtgcacgcacacgcacaagttcgcggattggcaaaaacagcaaattgcacaaggatgctttgtgaaaaaatgcgtttgacatttacagtgcataagggtaaaataagaatatcgaaatgtgtttgttctgtgcagacgcagagagaagattatggagggaataacaatgttagatccgaagaaagtaagactgggtatctgcccgatcggctggtccaatgatgatatgtgggatctcggcgacgagaacaccttccagcagtgcatctctgagatgaagctcgctggttttgacggctgcgaagtaggccacaagtacccggaggacaagaccgtcctcaagcacatgctggacgttcgcaacatgaccatcgcttccaagtggttctcctctttcctggttgacaagccgtacgaagaggtagaggctgagttcatcaaggagctggattacctgtcctacgttggcgctactgcaatcaacgtatctgagcagtccggttctatccagggccagctggacaccccggttctggacgacaagaagcgcgttctgaccgacgaggagtgggatcgcttcaccaccggcctgaacaagctgggcaagctgtccatggagaagtacggcatccgcacctgcttccatcatcacatgggcaccgtatgccagaccgttgaggagactacccgcctgatggagaacaccgatccgaagtatgtattcctgtgcttcgataccggccacttcactttcgctggcgaggatccggtaaagatgctcgagaagtttgctgaccgtgttggccacgttcatctgaagaacatgcgtatgccgctggttgagaaggctcgtgctgagcactggtccttcctggatgcagttcgcgcaggcgctttcaccgtaccgggcgatccggacggctgcgtagagttcgatgctgtattcgatctgcttgacaaggctggctacaccggttggatcatggtagaggcagagcaggatccggctaaggctaatccgttcgagtacgctaagatgggccgtgagtacatcactgcacacaccggtctgggcggcgaggttgttctgaagaagtaattcttcgcatatcgcgcgataaaacacgaaaccgagggcgtttgccctcggtttttgttttccgggaatccgcagtacaatcactgcacatacaaaaagctaaaacaactttttctgcatgagagcctctccttcctgccgcagactgtgggaaggaaaagagggtctgaccgctaatatgtaactgttcctgcgtgcattataacatgcggcagcgaaacctctcaataaaaccgcctttcagggcggtttttgccttaatacggcattgcgagggagcgcgatgtgttcccctgcaggtatacgcctgtcgagcgtttaccatcatcgcatccgccggaaagccgcgttcattcctaactcctgactcctgattcctgatttacaatctgcctgttatcaatagaaattgccgctatataacactatataaatcgttgcaaattctccgaaaatagggtagaatagtaaacaggaatagaataaggagtgtggagcatggaagcacagaaatataagcgcgtactgatcaagatcagcggcgaggcccttgcgggcgataagcatttcggcctgaactttgatgtcatcggtccggtatgcgatgtgatcaaaaaatgcaacgaagagggctgcgagatcggcattgttgtcggcggcggcaacttctggcgcggcgtaaaggacggcggcggcaagatggagcgcacccgcgcggaccacatgggcatgctggcaaccaccatcaacgcactggctctgcaggatgctctggagcagcgtggtgtggacgttcgcgtacagaccgctatcgagatgaacaagatcgctgagccgtacatccgctctcgcgcgacccgtcacctcgaaaagggccgtgtcgttatcttcggctgcggcaccggctgcccgttcttctcgaccgacaccgcagcggttctgcgtgcggcagagatcggcgcggatgttatcctgctcgccaagaacgtagacggcgtgtacgattccgatccggctgtcaacccggatgccaagaagtacgaccacctgagctacatggacgtgctcaatcagggcctcggcgttatggactccacggcaacctcgctgtccatggataaccatatcccgattctggtattcgcgctttccgaccccgaaaatattcaccgcgctgttaacggcgaaaagatcggcacgatcgttgaggaggtaaaataatgaaggaacagatcaagtcccacgaggcaaaaatgcagaaaacgctggacgtgctctccaaggagctggcagcagtccgcgcaggccgcgcaaacccggcggttctcgataagatcaccgttgagtattacggtgcaccgaccccgctgaatcaggttgcggcaatctctactcccgacccgcgcacgctggccgtccagccgtgggacggctcggtgctcaaggccatcgagaaggcgatccaggtctccgacctcggcatcaacccgcagaacgacggcaagcagatccgtctgaacttcccgccgctgaccgaggagcgccgcaaggagcttatcaagggcgtttccaagaccggtgaggaggcaaaggttgcgctccgcaacatccgccgcgatgcactggataagttcaaggcagcgcagaagaagagcgagatcaccgaggacgagctgcacgacggcgaggacaagatgcagaagctgactgacaagtacgtcaaggaagttgatgcaatggtagcgaaaaagtctaaagaactcgcagaagtttaattcagggggaagtccgctgcctgcagcggcataaaatcggattttcgcagaaaatccgtaaaaagcgggagcatgtatctcgctttttacacaagggagcatagctgtgtgccgcaaagcggcgcgtagatgtgctcgcaggacgtatccgagcgtatgctcggtacgttccgatcgaccgaaaacgtgttttcggtcgaggagcgaagcgacattgggggcggcggattcgtcgcccttttgcatgaaattggcaggaaaacctgccgcaagagggacaaacagggaggaaacaggttgggtctgttcacacgaaaaaagaaggataacgcgcccgaaaaccgtccggtgccgcgtcatattgcggtaatcatggacggcaacggccgctgggccaagaaacgcggtctgccgcgcaaggccggtcacaaggtcggcgcggagacgttccgcaccattgccacctactgcaaggacattggcgtgcagtatttcacggtctatgcattctctaccgaaaactggaagcgtccgcaggatgaagtcgatgcgctgatgaacctgttccgctcctatctgaaggaagcggcggaaaccatgttcgagcgcggcgtagccgtgcgcgtgctgggcgacctgaccgttctgccggaggatatccgcgcgcagatcgcggaggtggacgagattgccgatcggcttggttcggacgcggcaacagcttcgttgtgcatcaattacggcggccgtgacgagatcaaaaacgccgtccgcgccatcgcggagcgggtgaaaaacggagagctggcacctgaggatatcaccgaggataccatcaccgctaacctgtacaccgcgcacatgcccgatcccgacctcatcatccgtccttcgggcgagatccgcacgtccaacttcctgctgtggcagtccgcctactcggagtactacttcaccgatgtgctgtggccggacttcaaaaccaccgatctggatgcggcaatcgacaattttaacaacagaaaccgtcgtttcggcggcgtataatatccaattagggtgataaacgtatgaaagcaagagtattgtttggcgtgttcggctttgcctttgtgctgctggcgctgtatgtgttcccgccgatcgtgctggagcttgtcgtggcggcgctgtgcgtgttcgccacctatgaggtgctcggctcgacaaaactggtgcgcaaccacttggaactgatgctggcaatggccgtctcgctgggactggctgtcggtcatttcagcattctgccgctgcggctcgagagcgtgatgcagggactggtgctggtgctgctgttcggttcgtttgcgattgagctgaaatatcacgacgtcatgaaggcttcgcaagtctcgtgggcgtttttcggcggacttgtcgtgccgtacctgctgctcagcctgctgcgcattttccagatgcactaccaccacggttcgttcatcgtgctgctgccgctgcttgctgcctggggcgcggacacctgcgctctgttctcgggcatgctgttcggcaagcataagctggcgccggtcgtcagcccgaaaaagacggtagagggtgccgtcggcggcgtagtcggcggtgctgtcctcgtgctgattgcggctgtgattatgaaccggacgcttgaccttgaaatgccgctctggtcggcggtcgtgctcggtgcagtcggcgcggtgctcggcgagatcggcgacctgtcgttctcggtcatcaagcgccagaccggcattaaggattacggacatatttttccgggacatggcggtgtgctcgaccgtttcgacagtgtgctgttcgtggcgcctttcgccgaattactgttccgtattatctggtgatgtaaattgagaatggagaatggaaaatggaaaatgaatgtatcgcgcagagcgcgatgatttaattccgcccgcagggcggttccataattctccattctccattttcaattctccattatccaaatcgtttaacaggagaaaaataatgaagaagattgcgattttaggttcaacgggttcgatcggcacgcaaacggtcgatattctgccttcgatcgacgccgaagtcgtcgcattgacgaccaaccggcgcataaacttattggaggagcaggcgcgtgccctgcatccgaaaatggtctgcgcgatggatgaaaacgcagcaaaggagctgaaaatcaagctggcagacaccgatattgaggttctgaccggcatggacggtctgatcgcctgtgccgcggagagcggtgcggacatcgtggtaacggcggttgtcggcatggtcggcctgctgccgacgatggcggccatcaaggcgggcaaggacattgcgctggcgaacaaggagacgctcgtgtgtgcgggcggtctggtgatgagcgccgcaaagcagtacggcgtgcgcatcctgccggtggattccgagcattcggctatcttccagtgcgtgcaggcggcaaacggcaacccgatcgacaaaatcctgctgacagcctccggcggtccgttcttcggcaaaaagttcgaggaaatgcgcggcatgacgcgcgagcaggcacttgcacacccgaactggagtatgggtgcaaagatcacgatcgactctgcgaccatgatgaacaagggtctggagctgatcgaagccatgtggctgtatgatctgccgccggaggacatcgaaattgtcgtccaccgcgagagcatcgtgcactcggcggtggagtttgcggacggagcggtaatcgcgcagcttggcctgccggatatgcgcctgccgattcagctggcgctgacgtggccgcagcgtgtgccgtgcaaggtaccgcgcatgtcgctcgcggaggtcgcaaagctgacgttctatgcacccgactacgaggcgtttccggcgctgaatctggcaaagcacgccgcctccctcaagggcgaccgcggcgctgtgctcaacggtgcaaatgaggccgcagtcggtctgtttttgaacgataagatcggttttaccgacatcgcagagcgcgttgcatacgcactcgataccattccgtacaagaaggacatcacgctggacgacgttctggcggcggacaaagccgcgcgcgagatcgtgctcggctgaccgaaaggagctacgctttgctgcaaatcattctggcaatcctcgccttcggcgtgctggtcatcgtgcatgagttcggacatttcatcaccgcaaaacgcggcggtgtgcaggtcaacgaattctggatcggcatgggaccgaccctcctcaagcacgagcataaaggcacgctgtactgcctgaagctgctgccgttcggcggcgcgtgcgtcatggagggcgaggacggtgaaagtgaaaatgagcacgccttcggcaaggcgaagctgccgcgccgcatgctcatcgtgtgtgcgggtgcgctgatgaatttcctcgtgggattcctcatcgtgctggcggtcatgcagccgaacggcccgaacggcggctatatcgtctcgacgatcgcttcggttgacccggccagcaccgcagcgggcgacctgaaggcgggcgacgagattctcaagatcgacggctaccacatccttgtgcgcagcgattttgagaccgcgctcagccgtactgcgtccaccacgcataaggtcaccgtgcgccgagagggtgaaaaggtaacgctgccgtccgtcaagctggaggcgacagtcaccgatgcaaacggcaacaagcgcatcggcatcacctttgcggagctgcccgacagccttggcatgcacctcagcatgagcgtgcgcaccgccgtcaactacgcgcggctcgtctggtcgagcgtgggcatgctcgtcagcggacaggtcggcgtggatcagctttccggtccggtcggtgtggccgaggtcatggcggataccgccaagtacagcatgatttcgttcttccagcttgtggcatttatctcgatcaacctcggcgtgatgaacctgctgccgctgcctgcactggacggcggtcggctcgtgttcctcatcatcgagggcattcgccgcaagcccgtgccgcccaagtatgagggctatgtgcacgcggcaggactcatgctgctgcttatgctgatggtgtatgtgaccgggcaggacgtactgcgcatttttatgcgcagtaattgagaatggaaaattgagaattgagaattgtggagccgcccgaagggcgaaattaaataacggcgctgtgcgccgcacattcattttccattttccattctccattttcaattagtgagagaggtagaggtatgaaaaagaccaaacagataaagattcgtgacgtattggttggcggcggcgcgcccatcgcggtgcagtccatgaccaacacggatacgcgcgacgcgcaggctactctggcgcagattcgcgcactggcggacgcgggctgcgacattgttcgctgtgccgtgccggatatgcaggcggcagaggcgctgcgcgaaatctgcgcgaactcaccgctgccggtggtggcggacatccactttgactaccgtctcgcgctggcggcgatcgagtccggcgtggacaagattcgcttgaatccgggcaacatcggcggcgcggaccgcgtacaggcggtcgtgaaggcggcaaaggcacgccatctgccgattcgcatcggcgtaaactccggctcggtggagaagcacatcctcgagaaatttggcggcccgacaccggaagcgatggtcgaatccgcgctgtaccatgtcggtctgctgaacgactgcgattttgacgatatctgcatttctatcaagtcgtcctcggtgccgaacaccatgcaggcgtacctgctggcgagtgaaaagaccgactatccgctgcacctcggcgttactgaggcgggaaccgagtacatgggcacgatcaagtcggctgctggcatcggcggtctgctggcgctcggcgtgggtgataccatccgcgtgagcctgaccgatgatccggtcaaggaggtctacgcggcaaaggcgattctcaaggctgtcggcagagcggaagagggcatcaacgtggtttcctgcccgacctgcggacgcacgcgcatcaatctcatcgacattgccaaagaggttgagcagcgctgccagagcattcgcggcaagaagatgaaggtagccgttatgggctgcgtggtaaacggtcccggcgaggcgcgtgaagccgatctcggcattgcgggcggcgacggcgtgggcctgatcttccgccgcggcgagatcatcaaaaaggtgccgcaggagcagcttgtggacgcgttgatggatgaaatcgcacagtacgaaggagaataatcgtggctggaaagctgattgatatttttcaaaactgcaaatgtgtaaaagaggagaagcaccttgccgcaggcgaggtgcgttctctggcatttggggataataacacggtgatggtggtcgagcttggactgcacgaggttgtcagccgcaaggtgatcgccagggcggaaaagcagattgcggacacctacggtcttgaccgcgtgatgatcgagccgcgctacaacatgccgggtgagttgtcgaacgcgtacatcaagtcgctgtatgacgacatggcgtaccgcatgccgtcagccaagggtctgctcgaccacaccaagtgggaatttgcggacggtgcgctccagataccgatggacgaggtgagcgaaaagcatttcgcaaacgcactgcggcatctggaggcgcgtattcagcgggagctggggagaagctgtccggtgcacgcggtccgcgcggacgcacaggattttgcacccgcacccgagcaggaggagagccgcgaggaaattctgcacaaggctgtggagcaagcggcggcagccgcagcggaaacgcccaagccgaaaaagccgcgtccggcgccgcagcagcacaccggctatcagcgcccgcgcgccgaaaaggtgcgcgaggacgaccttatcttcggcaagctgattcaggaccccattgtttcggtcaacgaggcgattgccgcctatgatatggtgacgattcagggcgaggtgttctttaccgacaacaaggacatccacagcaagaaaaccggcaaggattacgtcaagattgcgtttgacatgaccgaccgcaccaattccgtgcgcgtttccaagttccttgcggcggacaaggcgggcgatacggcatctaaaatcaagaagggtctgtactgcaccgtgcagggcaagatggtgtacgacacctttgccaaggagatggtgctcgagccgaccggcatcgtcaaggcgaaaaagcccgagcgaaaggacacttacgagggcatgaagcgcgtggagctgcatctgcacaccaacatgagcgcgatggacggcatgagcagcaccgcgtctctgctgtgccgcgccgccaagtggggacaccgcgcgatggccatcaccgaccacggtgtggcgcaggcgttccccgaagcgctgcacgcgcaggagggcaagcagaaggacaccatcggtgacatgaagattatttatggcatcgaggcgtactacatcaatgacgagaacagcatttcggtcgtgcgcggcaggagcgccgagccgctcgacggcacgttcatcgtgttcgaccttgagaccaccggactcaatccggtaagcgaggaaattaccgagattgccgctgtgcgcgttgtggagggcgagattcgcgattccttccagacctatgtcaacccgcacaagccgattccggcggaaatcaccgagctgaccggcatttcggacgagacggtagcggacgcgcccgacctcgacaaagccgtgccggaattcctcgcatgggcaggcgagggacagtacccgctcgtggcgcacaacgcaggcttcgatatgggcttcctgcggacggcctgccagagactgggtatcgagcgggagtttacaagcattgataccctcgagatgagccgcctgatgctgccgcacatgcacaagttcaagctgaacattctggcgaaggagctgcaggtcggcccgttcgagcaccaccgcgcgagcgaggatgccgccgtgctcggccgcatttacgtcaagctgctgaaaaggctcagggaggagatgcacgcggttacgactgcggatatcaatccggtgctggcggcgacgaccgaccgcaagaacaagctgaaaaacctgccgcgctatcactttatcattctggtgaagaaccaggcgggactgcgcaacctgtatcagctgatttccaagagctttctggaatattacaacaagcgccccattatgccgcgcagcgaactcatccgtcaccgtgagggactgattttcggctcggcgtgtgaggcgggcgaggtgttccgcgcattgaccaagggcgagccgtgggaggagatcaagcggctggcgtcgttctacgactatctggagattcagccgatcggcaacaacaacttcatgatcgcaaagggcatggcgaaggacgaggagcagctgcgcgactggaaccgcgatattctccgcctggcggatgaattgggaaaaccgtgctgcgccaccggtgacgtacacttcctcgaacccgaggatgaggcgttccgccgtattctgatggcgggtcagggcttctccgatgcggacaatcaggcgccgctgtactttaagagcacggatgaaatgctgaaggagttctcctatctcggtgaggaccgggcgtatgaggtggtcgtgaagaacaccaacatgatcgccgacatgtgtgacgtgattcgtccggtgccgagggaaaactacccgccgcacatcgacggctgtgaggacgatctgcgcaacatgtgctacgaaaaggccaagcgtatctacggcgatccgctgcccgagccggtgcaggcgcggcttgaccgtgagcttggctccatcatcggcaacggctacgcggttatgtacattatcgcgcagaagctggttaccaagtcccttgcggatggctatctggtcggctcgcgtggttcggtcggctcgtcgctcgcggcgttcatgtcggatatcaccgaggttaattcgctcgccccgcactatctgtgcccggacgacaaatatctcgagtggcacgaggaatactcgtgcggtgtcgatctgcccgataagatctgcccgaaatgcggcaagccgctcaccaaacagggcttcaacattccgttcgagaccttcctcggcttcgagggcgacaaggtgccggatatcgacctgaactttgcgggtgagtatcagtcgcgcatccactggtacaccggcgagatcttcggacacgaccatgtgttccgagcgggcaccatcggcacggttgccgagaaaacggcgttcggctacgtcaaaaagtacatggaggagcgcggcatcgagtgctcccgcgcggaggaaaaccgcctggcggcgggctgcaccggtgtgcgccgcacctcgggtcagcacccgggcggcgttgtcgttgtgcccaaggagattgagatttacgacgtctgtccgattcagcatccggcagacgacccggattccgacatcatcaccacccatttcgagtatcactccattgacgcgaacctcttgaagctggacgagctgggacacgatgatccgaccattatcaagcatctggagaacctcaccggcgtgaacgcgcaggagattccgcttgacgacccggagaccatgagcctgttccactcgtgcaaggcgcttaagtacaagggcgaaaacccggataccgacccgatcctcggtgacctcggctgtgtggcggtgcccgagttcggcaccaagttcgtgcgcggcatggtaaaggagacgcacccgtccacgttcgcggagctggtttcgatttccggtctgtcgcacggcacggatgtttggctcggcaatgccgccgaactggtccgcaagggcattccgctgtccggctgtatctgctgccgagacgatatcatgaactacctgatcctgcagggcgtcaagcccaagctgtcgttcaagacgatggagtccgtccgaaagggcaagggactgaccgaggaaatggaagctgccatgaacgagcagcatgtgcccgagtggtacatcgactcgtgcaagaagatcaagtatatgttcccgaaggcgcacgcggtcgcgtatgtcatgatggcgttccgtatcgcgtggttcaaggtgcaccgtccgctcgcgttctattcggcgtacttttctatccgcgcgaaaggctttgatgcgtcctgtatgatcaagggcgataaggtttgtctggataaaatgtccgaactgcgcggaaaggagcgcgacaagacgatttcagcggcggaaaaggatatgatgacgactttagaggtctgccacgagttttacaggcgcggatttacgttcgagccgatggatgtttataaatcggacgcaacgcgctttctcgtgacggaaaccggactgattccgccgtttacgtccatgccgggcatcggtgagcaggccgcgctcagcattgtggaggagagaaagaacggtaagttcctctcggcggaagagctgatcgtccggtgcccgaaggcgtccaaggcggtcgtcgagctgctcgagcagatcggcgcgcttggctccatgccgaaaacaacgcagatgaccctcttttagaaaggtgtgacgattgtggcaaagttcgagaagcatttaaccggcaattttgatgaattcctgcagcggatttccgacagcgtgctgaatggcagcatgtccgcgtcgtatgaggacggctcggattggacgagcggtgaagtgcgctgtgcggtgcgcgtgttcgagcgttacagctacatgggcggcaaccgcgtcagcatgaacgtgacgctggtcggcaaaggcgaggagctgtttctgaccgcgatcacatccggcggcagccaggctgtgttctggaagataaacacgatgggtgaggaagcgtttttgcagacgcttatagacgcgatggagtgtaaggggtcctgcgttaattaagcaggagcatgcgcggacgatgagccgtttgcgaagaggtaaaccgtcacgttcacttcactctgataaaaagtgcttgacagcctgtggggaactatggtattattttaacgcgataaagtgataaaggagcagcggagccatgaaccgttttcgtatttccaccccggagggtacccgagacctgttattttcctcgtgccgtgcgctgcggcagacggaaaatgctgtgcgcgacgcgctggaggagcgcggctacagcgagatcatcaccccggcggttgagtattttgatgtatttgcacaggcaaaccccgagttggatcaggatcagatgctgaagatcatcgacaagtccggccgcatttgcgtggcgcgtccggataacaccacgccgatcgcgcgtattgcagccacccgactggatgacgcggcgctgccggtccgcctgtattacagccagaaggtgttccgttcggtgtccggcgatcatggccacaagggcgagttcctgcaggtcggcgcggaatttatcggcgcagacggtctggaggccgacaaggacattctcacggctgcgtttgccgcactcagcaagaccggcgcggacaacttccgtgtagagcttggtcacgctgagatctacaaggcgctgatggatgagcttggcgcggatgcacagtccgccgagggcatccgccgcctgatcgaaaacaagtcgtttgccgcgctcggtgacgcacttgagccgtttaagggcaagcccgccgcaaaggcgctcagcgctatgccgaatctgttcggcggcatcgaggtgcttgatgaggtcgagtcgctcaccggcaacgtgcgcgtgctcggcgcgaccgcttatctgcgccgactgtatcaggcactggatgaggcaggctacggcgaccgcatcatgatcgacctcggccttgtccacgagatggattactacaccggcatcatgttccgcggctacatcggcggcgcaggcgcggccatcctcgcaggcggccgttacaacgcgctgtgcgccaagttcggcaaggatatgcccgcgggcggcttcggcattgacgtggagagcgttgccgacagccttgcaggacagagccgtcccgaggtcgcaacccgccgggataccgtgcgtatcgcactgaccaagggccgtctggagaagaaaacgctcgcgctgctcaaggccgcaggctacgatatctccgagctggaggccggaacgcgcaagctcatcttcacattgccggacagcggcgtggagatcgtgctgagcaaggccgcggacgtaatcacctacgttgagcacggcgtgtgcgacatgggcgtggtcggcaaggataccatcatggaaaagggcggcagcttctacgaaatggtagatctcggcttcggcaaatgccgcttcgccctcgccaccaagaagggcaaggacgtgtacggcggctataagaccccggttatcgctaccaagtatccggcggtcaccaaggcctttttcaacaagaagaatatggatgtggaaaccatcaagatcgagggctcggtcgagctggcgccgctgctcgagctggcggacggcattgtggatatcgtggagaccggcacgacgctcaaggagaacggcctcgaggtcgttgagaatgtagcgcccatctcggcaagagttatcgtcaatctcgccagcgccaagatgaagaaggcagcgattcagaaggttattgcagagctggaaaacggtttgaataattgagaattgatgatggagaatggaaaatgaatgtgcggcgcatagcgccgttattaaatcatcgcgcaaagcgcgataccacaattctcaattatcaattctccattttccattcatacagggaagagaggcagcagatgtttctaaatatagtaaaggcggacggacaggcagagcagcaggtcatccgcgaaatgaaggcccgtgcggctggtgcgcgcggcgatattgagcagattgtccgcggtgtgatggcggacgtacagcagcgcggctgggatgcggtcgtggagtacgccgagcggtttgacggcaaggcgccgtacattgtcgagccgaaggtgcttgacgatgcgtacaacgcctgcgacccgaagctgatcgcggcgttggaaaaggcggcggcgaacatccgcgactaccacgagcagatgctcgtcaaaacgtgggagtggaaccgctccaaaggcgaaacgctcggtcagaccgtgcgcgggctttcgcgtgtcggcatctatgtgccgggcggcacggcagcgtatccgtcgagcgtgctgatgaacgccattccggccaaggttgccggtgtcggtgagctgattatggtcacgccgccgaccgagaatatgtccaacgaagtgcttgcggcggcgaagatcgccggtgtagataccgttattgccatcggcggcacgcaggcgattgccgcgctgacctacggcgcgggctttatcccgcaggtggacaagatcgtcggcccgggcaacgcctttgttgcagcagccaaaaagctggcgttcggtacggtcgatattgacatgatcgcgggcccgtccgaggtgctggtcattgccgatcacaccgccaacccgacctacgttgccgccgacctgctcagtcaggccgagcacgacaagctggcttccgccgtcctgctgaccgattccatggcgcaggcgcaggcgatttcgtgcgagatggagcggcaggcaaagcagctcccgcggtgggacatcatcaaggagagtgtggcgaactacggctgcgccatcgtgtttgacgacctgaaggacgcctgcaaaatggctgatgtggtcgctcccgagcatctggaggtcgtaaccgccgctccgcgtgagctgctgccgtacctgcacaacgcaggcgcgatcttcctcggtcagtatgcgcccgagccgctcggtgactatatggcaggcccgtgtcacgttctgccgacctcgggcacggcaagatttttctcgccgctgtccacggacacgtttttgaagaaaaccagcgtgatcgagtacacgcgggacgcgctcgaaagctacgcacaggatattatcgcgctcgcgcagagcgagcatctggacgcgcacgcaaactccatcgcggtgcgctttgcggaggaaaacaacgatgagaaccgctgaaatcaaacgaaagaccaaggaaaccgacatttcgctcaagctgacgcttgagggtggcgaacgcaagatcgacaccggcatcggctttttcgaccatatgctgaacagctttgccgtgcattccggcttcggcctcacgctcacctgcaagggcgacctcgaggtggacggtcaccattcggtcgaggactgcggcatcgcactcggtcaggcactggcgcagtgcgtcggtgacaaggcgggtatcgcgcgtttcggacaggcgttcgtgccgatggacgaggcgctcggtttctgcgcgctggatatctccggccgcccgtacctcgtgttcgacgcacccatgccgcagccgatgtgcggtcagtacgacacctgcctgacggtcgagttcatgcgtgcgctggcggtacacgccggactgacgctgcacctcaagtgcgagtacggcgagaacgcgcaccatatcacagaggcgctgttcaaggcgcttgcacgcgcgctcaagcaggccgttgcggttaccggcggcggggtgctgagcgcaaaaggtgttctctaacggttagcagtaatggaaaatggaggatggagaatggagaatgaaggtatcgcgcattgcgcgatgattgaattccgcccgcagggcggctccacaattttcaattttccattttcaattctcaattttgaaaggattagcaatgggctacatagcaatcgtagactatggcgcaggcaatctgatgagcgtacacaacacgctcgattacctgggttatgaaaataaaatcgcggcttcggcggacgtgatcgagaacgcggcgggcgttatcctgcccggtgtcggcgcgtttccggatgcgatggcggctttgaccgactctggtttgacggaggcggtgctgaaggctgcaaaggaaaagccgttcctcggtatctgcctcggcatgcagatgctgttcgaggaatcggacgaggtgcgtccgtgcaggggtctgggtctgctgccgggacgcattgagcgcattgagacgagtctcaagctgccgcagatcggctggaatgcgctggacattctgcgtccgaatgccatgaccgagggtctggaaaacggcagctatgtgtatttcgtgcacagcttcatggcgcatccggcggacgaaaacgaccttgccgccgtgacggattacggcacgcgcgtgcctgctatggtggcgcgagggaacctgttcggctgccagtttcacccagaaaagagcggtgaagtgggacttgcgatgcttcgcaactttgcaaaactgacggaggtgggaaaatgagagttatccctgcgattgatttgaaagacggtcagtgcgtgcgcctgcagaaaggcgactacggcactgcacataaagtagcagaaaacccggtcgagactgcacagcggttcctcgatgccggtgcagaccttgtacacatggtggacctcgacgccgcgaaggacggctcgcacgcgaactacggcgtggtggagcaggtcatccgcgagaccggcgcgaccgtggagcttggcggcggcattcgctccatgcaggatgtggagactgtgcttgcactgggcgtttcgcgcgttattatcggctcggcggctgtccgcgacccggaattcgtagccgaggctgtaaaaaagtacggcgacaagatcgtggtcggcatcgatgccaagagcgaaaccgtccgcacggacggctggttgggcgacagcggcgagaactacatcgcgttcgcagagcgcatggagtccatcggcgtgcgccacatcatcttcaccgacattgacaaggacggcatgctcgcaggtccgaactttgaccagctggcggcgctgcgcgcctcggtttcgtgcgagatcatcgcgtccggcggcgtgtccaccctcgagaatatcgccggcctgaaaaagctcggcatcgacggtgctatcgcgggcaaggcggtttatacggggacgctcgatctgaagaaagccatcagcgaagcgaaataataattgagaattgaaaatggagaattgagaattatggaacggcgcgaagcgccgcattaaattccgcgctttgcgcggcacttcgtcgcagtgcggatggaactcgcgcaaggatagctcgtcgcagcgcggatggaactcgcgcaaggatagcgacattttccattatccattttccattctccattccaatgcgaacggagtgagcaaagaagtgttagcaaaacgcatcatcccctgtctggacgtaaaggacgggcgcgtggtaaagggcgtgaactttgtcgggctgcgcgacgcgggcgacccggtcgagctggcgaagttctactcacaggagggcgcggacgagatcgtgttcctcgacatcaccgccacgagcgacaaccgcgacaccattgccgacgttgtgcgccgcacctgccgcgaggtattcgtgccggtcacggtcggcggcggcatccgcaccgtggacgatttccgcgagattttacgcgccggtgcagataaaatttccatcaattcctcggcggtcaagaatcccgatctggtgaacgccgctgcggagaagtacggcagccagtgcgttgtggtcgcgatcgacgcgcgtgcgaatgccgaaatgccgtccggctttgaggtttacgttgcaggcggccgcaccccgaccggcaaggacgcggtcgcgtgggcgaaagaggtttacgagcgcggcgcgggcgagatcctgctgacctcgatggacaaggacggcaccaagtccggctttgacctaaagctgaccaaggcggtcgtggaggtggtcggcattccggtcatcgcgtccggcggctgcggctcgctcgagcatttctccgaggtgttcgagaaaaccggctgtgatgccgcactggcagccagcctgttccattatcgggagctgaccgtgggcgaagtgaaggaacatttgcaggaacgtaacattcctgtaagacggtgaagtaattgagaattgaaaatggagaattgagaattaaggaacggtgcgaagcaccgcattaaattccgcgctttgcgcggcacttcgtcgcagcgcggatggaactcgcgcaaggatagctcgtcgcagcgcggacggaactcgcgcaaggatagcgatattttcaattttccattctccattaatccattaaaaggtgaatacaatggaattatctaaatttttcaaaaaggctcctctggtgccgattatctgccaggacgagcgaaacggcgaagtcctgatgctcggctacgcgaacgaggaggccctgcagctgacgatggacaccggcacggcgtggtttttctcgcgctcgcgccagaagctgtggaacaagggcgagacctcgggcaattttatctttgtcagcaggattctgtccgactgcgacgatgacacgctcatctatgtcggcacgcccaagggtccggtctgccacaccggacaccgcacctgctttttcaccacgctgtgggagaagccggaagaaaagtaaaaggagagcagtattatgaattcgtttgagcaaatggaagccgttatcgcgcagcgccgcgccgagccgcaggaaggctcatacacctgctatctgttcgagaagggcattgacaagattctcaagaaggtcggtgaggagtgcgccgagaccatcattgcagctaagaacggcgacaaggccgagctggtcggtgagatcaacgacgtattctaccacatgatggtaatgatgaacgagtgcggcgtgacgatggaggatgtctgcaaggaaatggacatccgcgcccagaaaatcggcaacctgaagaaattccacgtttccgaccacaatacctaaaattgagcgaacagagagacctgtgcatttttgcacaggtcttattgttttgtcggaaggaatatggtatgatgaacctgaggtgagcaatatgcgtagaaaagacagagaaatcaccggccgagagaacatcgagccgatcctgcaggcatgcaaggtctgccgcgtcgccatgaccggcacggacggctggccgtacgtcattccgatgaactttggctacacctgggatgaggacgggctgacgctctactttcacggcggcgtgaagggcaagaagatcgattcgctgaaagccgacccgcgcgtgtgctttgagctggactgcgaggagggtctgaccggcgagggcgacttggcctgccggtacagctatgcattctcgtccatcgtggggtacggcaaggtggaatttgcaaaggataatgacgagaaacggcagggctttgacgttatcatgcagcaccagaccggcaagggcggctggacatacacggacgcggctctgtccgtcaccgaggtgatgcgcgtgcgcgcggagtcgtttgaggcctcgcgcaaggcgccgaagggatgagcatgaagcacatcggtaccaaaattctggcaggcgtgctggtggtgctgctggcgggagcgggcgtgctgatctggcgcaatctgccggaggatgcaccgcgcctgcaggagccggaggagaccgttcggcaggagccggaggtgcagccggacaccacagcgaccctgtgcgtggcgggcgatattgtggcgcacatgccgcttgtcgcggatgcgtggaacggcgaagcgtatgattttacgcacctgttcgcggacgcaaggcggtattacgaggctgcggattacacaacggcctgtctggagaccacgttcaacggtccgccgtattcgggctacccgcagttctgcgcaccggatgcgctggcctacggcctgaaaacggtcgggtttcacctgctctccacggcgagcaaccacagcatggataccgggtacagcggtctggtccgcacactggatgtgctggacgccgccggtctggagcacgtcggcacttaccgtacacagcaggagcgcgacacggtgaagatcatcgacgtgggcggcatcaaactggccatgctggcgtataccttcagtacaaacggcctgccggtggacagcgagcacccgtactgcgtcagcgtctacacgagcgactacatgaccgactgcagtgcggtggattacgacctcatccagtcggatctggacaaggcggggcagtccggtggggatgcgatcgccgtgtatgtacactggggaaacgagtaccacaccgagccgtccgagcagcaggagcagctggcagactacctgtttgcgcacggtgcgacactggtgctcggcgggcacgcgcatgtgccgcagccgatggagctgcggacgctgccggacggccgcacaggctatctgtgctactgtctcggcaacctgatctccaaccagtttgacccgtacaccaacctgacggcggctgtcacgctgacactcaccagaagcggcgagaccggacaggtgacggtttccggcgcggagtacgtgcccatgttcatgctgcacgcaagcgactccaacgagggacgctaccgcctgctggatattcggaaatccatgcaggattttgagcagggggatacgtcggttgtaaaccggtcggtgtatgaccgaatgaagcagggacgttccgacctgcaccgtatcttcggcacggatgaggtgctttccctcgcagcatgagaaaatgtttacggtttctttacatacaacgctcgacactgtgttgactttgcgacacgatgctgatacaataaatctgtaccaaaaatacacagtccgcagagaaacagggaggaacggttcatgccggagacgaaaaacaaccgcagagtgcgctttacgcggtctgcgctgcgtgaagccctgatcgacctgattctggagaagccgctggtctctatcacggtcaaggatatctgcgcgagagcggacatcaaccgctcgaccttctacctgcatttcaaggacgtgaccgacatccttcgcacgaccgaggacgagatcatcgagcacatgcgcgagcacacgccgacgcacgaacggaagttccgcgatctgcaggagatcgaggggttctttatcgactttctggagcagatccggaacaatccgcgtataatgaaggtgattcaggtgctgtgcagcgagcagggagacccatattttgtacgcaagctgcagaccatgacgtatgaagccttcctcgacggctgggatatgcacatgatgccggaaatgagcgagcagcggaagctgcttgtgttttcatataccatttcgggcatggtatccatgctgtccacctgggcgaccagagcgcaggacacgccgaccgaccaggtcgtatcgcttttgatggggctgatgtggcacggactggactattttgcagcatccgacaaaaaaagtgcttttccgaccgaataagccacttgacatttctatggggaaatggtatattatagttgcttcgtaaatatgcaatgttttccgtcgatagcattgcggatcggcccttttcggtgtattccgggaagggtcgattactttttatataaaaacctttgagggggagaaggaattgcacaaacagggagctttgcgcgaattcgggcactatgccgcgatgaacatcctggggatgatcggcatttcgtgctacattctcgcggatacctatttcgttgcgcagggactgggttcgctcggactggcggcgctcaacatcgccataccggcgtacaacctgatgaacggcatcggcctgatgctcggcgtgggcgcggcaacgcagtacacgatcgcgcgggcgcagaacgatcggagacaggcggacagcgtattcacgcacgcggcggcgctcggactgctgctcggactactgttcctgctcggcggactgtgctttgcaaaaccgctcgcgggcctgctcggcgcggacgcgcagacgctcggcatgacgacgacctacctgcgcatgctgtggtgcttcgggccgttcttcgtgatgaacaacgtgctgctggcattcacgcgcaacgacggtgcgccgaccgttgccatgtgcggcatgatcgcgggcagcctgttcaacatcgtgttcgattacattttcattttcccgtgcagactgggcatgttcggtgcggcgcttgcgaccggcttttcgccgtttgtcagcattctggtgctgctgacacacctgcggaggccgtcccgcggcttccatctcgtcaaaacgccgctgcgcgtcagccgtgtgccgagcctgtgcgcgcccggtctgtcctcgctcatcggtgaaatcgcctccggcgtggtactgctgctgttcaatctggtgctgctgcgcctcagcggcaataccggcgtggcggcttacggcgtggtggccaatcttgctctggtgggaatcgctgtctttaccggactgtgcaccggcatacagccgctggtcagccgcagctcgggtctcggtgacagggaacagctgcggcggctgttccgctggggcatctgcaccgcgctcgggattgcagccgtgctgtgcgtgtcggttttcctcggcgcggagccgctgacggcggtgttcaacagtgagcatgacccgcagcttgccgcctacgcggagagcggcctgcggatctacttcacgggtttcctgttcgcgggcgtgaacatggtcacggcagcgtttttcagcgcatcggataagaccgtgcaggggtttgtcctttcgctgctgcgcggcgtgatcgccgtgccgccgatcctgtttccgctcgcgtgggcgctcggtgtcgatggcgtctggctgacattcccgatggtggagctggtcacggcggtcgctgcactcgtctgggcgagaaaatacattattgagaattgaaaatggagaatggagaatggcgctatccttgcgcaggctccggtcgcgctacgcccgtggcggtttgcgttgattctccattttaacaataatcaatctgtaaaactgtataatgtgccataaaacagcgaaaaagacgtgtaatgcacgtctttcgcttaacaggatttcatctgtatggtataatactggtgttgccctacttattcccggcaacgggaaggaggtgcgccaagtgaacttcaccgtatcgttaatctgctccattatggcaaatgtaattgcacactacatttgcaagtggctggatgagcagaagtaaggcaacatcagccccggcttaagccaccgaaaaacggaatagaaaacccccggagactggtactctccgggggttttcgccaagtgaactaattcatatcgttgcttatagtatagcaccgattgtgaaataatgcaagcgtttatcctgttaaccttacagctcttccacaagcgccttaaacagcttgccgcgttccatgaaattcttaaagcggtcgaacgacgcgctggccggactcatgataacaacatcgccgctttctgcgcgggcagcggcctcctgcacggctgtttcgaggttttccacctcgataatcgggggatgctcgccctcgatattctccacgcactcgcgaatcttgggtgcagtagcgccggtgagcagcagcagctttacatggtcgcagataggctgaccgagcacgtcatacgggatatgcttgtcgtagccgcctgcaatgagaatgaccttctgctggaaggaattcagtcctgcgatggttctcgtcggactggaggcgatggagtcgttgtaatacttcacgccgtccttctcgcgcacgaactcgatgcggtgctcaacgccgccgaacgtggtcgccacggcgcggatatcgtcgtcagaggcataaccctgcacgacagccgccgccatcatcatgttgtacacgttgtgcgcgcccggaatgcggatatcggatgcgggcatcagctcacggcgcacgccgccgtccgcgatgtagataacgtcgtccttgaggaacacgccgttggccagctcctgcgttttgctggtgcagaacaggttgccggacgccttgagcgagcgcgtcacctcatcgtcgagattgaggatcagcttgtcgttctcgccctgattgcggtaaatggcagtcttggcctgcacatactcgtcaaaatccttgtggtagtccagatgattgggcgtcagattggtgatcgccgcaatgtgcggagagtgcttcatgcccatcagctggaacgaggacagctccacgactgcaaggtcgttttcggtcatcgtgtccacgcgggggagcaggggcgtgccgatattgccgccgagatgcacggtatagcccgcgtgcttcaaaatctcgctgacgagcgtggtggtcgtggtcttgccgtccgagccggtgatgccgatgatcggacacgggcagaccgcgaagaaaagctccatctcactggtgatctccgagccgtttgcgcgcgccttctcaagaaaacgcgggtgaacgcccggggtacggaagataacgtcctcatcgagcgcatcaaggtaatgcgggccgagaacgaagtctacgccgagggtagcgagggtagcatagccgtcaccaagctcggtgggttcttttttgtcatgcacggtaacgcgcacgcctgcagcgcgcagcatacggatgagcggcatattgctcacgcccgcgccgattacgccgacccgtttatccgacaggccgccgaggtattgttctaatgctgtcataaatgcgtaacaccgccttttgtactttgacagtatacatgatttttcacgattttgcaagtccggtttgacgagagcgtttttttacggtataatgctatttgtgactggtgcagacggtcgcgtgccttcgggcatgaggaaagtccgggctgcacagggcaaggataacggataacgtccgccgagggtgaccttaggaatagtgcaacagagatataccgctgttttatgtccgcataaggcagtaagggtggaaaggcgaggtaagagctcaccacgtcccatggcaacatgggaggtctgtaaactctatccgcagcaacgccgactgggactatgatttgcccgatcgtcccgactggcggcttgagatgcacggcaacgtgcattcgagatagatgaccgtccacgacagaacccggcttacgcaccagtcatgccatagcaccgcagaggagacatcttctgcggtgcttttcttttacattctgcaggaattgataattgaaaatggagaatggagaattaacgctatggtgtaatcttcttcatgtatttatatctcgttatgaatgtaaaccgcagggtgcgccaaggtgaatggcccgaagggcaggagaaggtgctctggggtgtgcccctacgggatacatagtacacttctataaaaactgccgttgcattttgtcgctttttccatattctgcgctgaaaaaatttgttatacttgaggcaggatagggaggtgcattttatgaaaggactgggaaaacgaatcctcgtgatggcggctgtgacggcggtctgtgtgtgggcagcgggcaaatcgagttacgcggtaaaaccgtaccgactggatggggacacgcttgcacagcaggtgcagatgcttaaggagaacaatctgacgaagttctccggtgtgacgatatacgatggtatcgtaatcggtgacacagcgcattatgtaatgaagcaggattttccagagcaggaaggtatgcttggcgaaatgactgcgaaacgcagctggcttggtacatggaaattttacagtatgggctacggcgattccggtatcaactacgatattatcggctgcggcggacacaattttctgctgctgagcggcaaggactcggaacagcaggttgcaaaggtgacgctcaactggtatggacagacctatgagatgacgaatgagagtgcaaagccgtattttctgctctgcaccgagctgaccggatacatgccggatgagttgctcccgtcggaggatatgttccgtttttacgataaaaacggtaaggagattccgcgctggtacgattcatacagcggctcgatggatggttcaagtattgcggtcgcacaaggcagcatttacaaggcggaatagacaaggagcacctgcggtcggcaggtgctttcttttgataccgagattgaatggtttgcgggtgaacactgttcgtccctgcggtaaagccagcgattactcgacgcagcgcagacggaactcgcgcaaggatagcgacaattcctaactgccaattcctaattactgatgatccgaacttgcttacagctatatgaatgtgttataataaaatttaattggacaaacacaagggaggaaccactgttatgatgatcgaatgtccgcactgtcatatggaaaccgaacacaaggtgatcgaccatatcaatatcgaccgaaatcccgagctgcgggcaaaggtacaggacctgtctgtttttcgtgtaaaatgtccaaactgcggcgaaaccgtgctcgccgtacacccgtgtctgtaccatgacatggcaaatcagtttatggtatggctgtggaccgaggacggtcaggttcccaaggcggaatttgatccgctggcaggctacaccctgcgcgtgaccgacagcctcaacaccttccgtgagaagatcaacatcctcgagcgcggtctggatgaccgtaccatcgagatcatgaagctgctgctgttcgcacagctgaaccgcgacctcgatgttgtcgagctgctcttccacgagctggatgagcgcaccggcgatttccgcttcgtggccgtgctttccgacggcgcggagcagtatgccgccatgccgggcgcggcgtatcagcgcctgcacgcggatgtggaaacctatctgtacacgccgggcggcgagttctcgcgcattgatatgacgtgggcgcatcaggcacttgagctgctgcacgagatgggctgacggtttaccttctccgcagggcataaaaaaggatgtgccgttttgacacatccttagattttttcattctcagccgataagcagctgcaccagcgtgccgccgatcacggcggtggcaaacgttgcggcgatgaccggcagggcacgatgacggccttccttctcctcgagaagaacgatgtagccgaagcctgcgccggtggaaagaccggcaaccagagcgccgaagctgatcgtgccgccgacaaacagctcgctgagcagcacgctcatcgcacagctcggaatcagaccgagcaccgcgcacagcagaggctggaagatgctgttggtcagcatgagggaagccacgcgctcctcaccgatgccgtgcacgaccatgttgagcgcgaacagcacgacaaacaggaagatggtggtcttgatggtgtgggacaggatattcgccactggcgaggtctcacagccgcagtcgcccatctcgatctcaagcgggccgtcggttccggccttgtgcttacggaacacggtgcagcgcagaacatagccgccgatgaccgcgatcgcaaacttgaccacgagcagcagcaccacctgctgtacgcttgcgccgcctgccagcatgatgggcaccgcctcatccgaggtggcaaggaacacggcaaccagcgttgccggtgcaagaaagcctgccgagaacagcgcggacgctgccgcggaaaatccgcactggggaatggagccggcgagcgcgccgaccaccggaccgaactgcgccgcacgcgagagcagctccggcgtattggtcagccggttttcaatgtagtacagcagtgcgtacacgaccagcagcagcggcacggtcttgagcacatcgaaaaatgcttccggcagaacgtgatgaataatttctaacaaataggtcacctcatagttgatctgtgggttgataacattcgtgttgtctcagagacaattataataagtatagcatagaacccagtccgcaggcaagcgggatttgccggactgcataccaaagatagcaaaaggaatcgaatatttaccatgaaatttaacgaactcaagttggagaaaaacatcctcaaggcactgaaggaggcaggctattccgagccgacgcccattcagcagcaggcgataccgccggtgctcgagggccgcgacctgatgggctgcgcccagaccggcacgggcaagacctgtgcgttcgcagtgccgatcatccagcgcctggcaaagagcgagggcagaaagggcaccatccgtgcgctcatcctcacgccgacgcgcgagcttgcgctgcagatttacgaaaacgtgtgccagtacgcgcgctacatgccgtgcagtgcggcggtcatcttcggcggcgtatcgcaggtgccgcaggtcgaggcgatcgaacgcggtgtggatattctcattgccacgccgggccgtctgtgggatctgatgggtcagaagatcgtaaagctggacaaggcagagtttttcgtgctcgacgaggccgaccgcatgctcgatatgggctttttcccggatgtcaagcgcatcgtcaagttcctgccgaaaaagcgccagaccctgctgttctcggcgaccattccggcggagattgccgatctggcagagaaaatgctgcatgagccggagcatatctcggtaacgccgagcgcaaaaccggcggacaagatcgagcagcagctttattttgtagaaaagcaggaaaagagggaacttctgccggatatcatccgtcaaagcaatgtacaccaggttctggtgttcacccgcaccaagcacggcgcagaccgggtcgcgcgcgacctcaaccgtgcgggcatcaagaccaagtccatccacggcgataagtcgcagaatcagcgccagcgtgcgctcgcggacttcaaggagtgcaagatcgcggttctggttgcgaccgacattgccgcgcgcggcatcgacatcaacgacctgccgctcgttatcaactttgacctgccgaacattccggaaacctatgtgcaccgtatcggccgcaccggccgtgccggtcaggagggcaccgcgatttccttctgcgaccgctccgagcgtccgtacctcaaggatatcgaaaagctgatcggcaagcgcattccggttgccggtgagattccgcacgaggaaaaggaggaggagaagcgcgagtccggtcagcgcaggacgaccaacaagcgctcccgccgcaagccggtctccgagaacgccaccgccgaggaggtcgccgcagatgtggcccgcgaaaaggaagccaagaagaaggcgcgtcaggcgagagcgaatgccaagcgtccgtcccgccgcgagaaggccgtcgagcagcagaccgagcagcaggcgaaggcagccgcgccgcgctcccgcaagggcagaaacgaccgaaatgattcgagccgcagaggccgccgcagcgacccgtacgcccgcttcgagaagaacgagccgcgcgtagacgctcacacgccgagccgcgcgtatgcgctcagcgatgaggctgccgcacgcatccgcaaaaaggtcgaggccgcactggccgctcgtgccgcaaaggcggacggcaaggccgctccgcagcaggagaagaagggcaggggacacggcagcaggtctgcgcagaagcccgcaccgcagcagaacaagacggcacagagcaagacggcacagagcaagacgaccaatcaccgtcatagacgccgccgcaccccgaacaacaaccgcaaaggttaagaagttgctgtcataaccattgcacaccgcctgaacggcttttttgccagcatactgcgttgttttcccttgcaatccgtcaggattcctgcggaaaaacgccttatctgctgacaaaaaatctcgttcatccggcgcactctggctatgaaagcaacttcagtgatagagacaaacccgaaccgtatcccgcggttcccggactgagagagaaggagcaacacgaatgaacggcgcaaaacaccgcttcgcactgggactgacctgcttttttctgatcggcatcacggttgtgtatccgtttcttctgtacacaccgaacgcgttcgtcactcgctggcgtgagtggtacatcgaaaccgcaatgggcaccatgacgcaccagtggctggccacctggttcatcccggagaacatcatcaacgaggtgatgaccaagcgctacctgatgaaccagaagcaggagggcatcgtcagcaactgggacggcgcatgggaggagaaagaggaggacaccgccgaaacaccgaagaacaaattctatgccatgttcagtgagctggacgagagcgaatttgagcgctttctggcggataattcggagtatctggagaacggctacgacgagatcaacatcgacctgatcggcgagccgagccagacacactacgacaccggcctcaagacgaagcagggcgacacggttctggcggtcaacgccgcgcacggcatcctgatcgtcgagcagaccggcgaggacacgctcggcatggagtacgcgggcaaggtcgcgctctgcaaaaagcccgagaatatctatgtcggcacgagcgagggccttggcgattacggctcgttcgtatccgatatggtgagagattatgacgctattctgggcatcaacgcctccggctttgccgattttgacggcaacggcacgggcggcaccgtgtacggcttcctgaaaagccagggagagaagtatcaggacgcagtaggcaacggctggaagatcatcggctttgacaacgaggatcatctgcaggtcggtgcgttcaacgatacctccagtctgcgcgacgcggtggagttccacccggcgctcatcatcaacggcgagaatctggtcgcaggcaccggcctgaacgagcagcagccgcgcacggccatcggtcaggcgaaggacggcacggttatcatgatggtcgttgacggccgtcagatgcactcgttcggcatttcgatcgagcgctgcggcgagatcatggagcagtacggcgcatatcaggcatccatgctggacggcggttcgtcctccgttatggtctaccgcggccgcgagatcaccagtccgactacgctttcccagaatgaggaaggccgttatctgccggatgccttcctggtgaaataaaaattatcacgatttcggaaaaagcacttgtattttccgccattgcatgatagaataaataagcgcctgtaagacaggcgcgatacggagaagtatcgaagtggtcataacgagctcgactcgaaatcgagttggcggtaacacgccacgtgggttcgaatcccaccttctccgccaaaacaacagccatccattcggatggctgttgttttttgctccgaaggtgggattcgaaaggcggctcttagaaacatgccagtggcatgtttcaaccgccgtggcatttgccgcagcaaatggaatcccaccgcccagatctcagcgcccgctccatacggagggatggcggctcttagcagagtgccggtggcactctgcaaccgccgtgggagcccgtaggccgacaacctctaaaatatttaatggttgcttgccgcagcaaatggaatcccaccgcccagatctcagcgcccgctctgtacggagggaaaggcggctcttagcagagtgccaatggcactctgcaaccgccgtgggagcccgcaggccgacaacctctaaaatatttaatggttgcttgccgcagcaaatggaatcccaccgcccagatctcagcgcccgctccatacggagggatgggcggatttgggcagcgtgcatgaggtgcttgccgtaacatctccgcaaaaaaaataaaaaaatttctgccggccaacagaatttcccgaagggcggcagtttatcatgttgccagaagccggagacaaagtgcgaaaaagtgtcgattttcgcctgttttgataataattttcagggtttgaaaatttatcaaatttttttgcaaattttgttgacaaagggggacacccctgctataatatatcttgtcgctgagagacaagcggttcgccgcgagagatcaatgcgagtgtgctggaactggtagacaggcacgtttgaggggcgtgtgtcgatcgacgtacgggttcaagtcccgtcactcgcaccaccttctttcaacaaccaaatatgcggatgtggcggaatggcagacgcgctagcttcaggtgctagtgttcgcaaggacgtgggggttcaagtccccccatccgcaccaagttaaagagcttcaaacttacgtttgaagctctttttctgtacttttcggtaaacccgccggagcagggaggaggctgtccgatacccttgtctaacagattgtctgccatttcacccaattccgcagaatgcaccaaaaccaagccgacagaccacggattttctgtattgacacctgcccaaaccgtggtacaattataacagaaaaagcagagtagagcacaatgcgttaagtgccgctgaaacggggagttgttcggcggacgaaagggagccttttccttgcggtattgtggtcgcatcccgctgctgcaactgtttaggcactttcctaaatcgctgtggcaacagatgaatttgattaggaggtgtctttttctatgtctaaaactccgaatatctttgtccgctcgctgcgtgagctgaggtccacccgctgtctggcggtcacggcgctgctcattgcgatcaacgtcacgctggatctgctcggcctgtcgatcaagctgccgcccaacctgcgtatcggcttcggcttcctgtgcaatgcgtcgatcggcatgctgttcggcccggtcgtcggcatgatggccggcgtgtgcaccgacgtgctcggctactttgcgggcaacctgtccatgggcgcgtatttcccgggctatacgctgacagccgttgtcggcggtctgatctggggcctgtggctgtatccgcgcaagatcaccgtatggcgtgccatcggcgcaaagacctgcatcaacctgttctgcaatatctgcctgaataccctgtggctgaccgtcaccggcggcaaggcgatgagcgtgctgctcgttacgcgcgtgccgaaaaaccttattctgctgccgatcgagatcgtgctggtctacttcggcatgaagctggtcaaccgtatctatggcgcgctgccgaatggaaaggccgctgcggaaaactcttgagtaagagcggagagaaacctgtctccacctgataacagtcccccggctctgtcgcttgacaaaaccgggggatatgctataataaagccaaagggacactgttacagcagtcaggcccttgtactttcatcagttaaattttgatgaccgtttcgggtaccagccggacggtcatcgcgcttttatacagaaaatgtacagtacaatgaccgcacatacaaaaagctgaaatgctttcttctgcacttgcgccacctccttcctgccgcggactgcgggaaaggaaaagagggtctgaccgccttatgtaacagtgtccgcaatgattatagcatataacaccgaataaagtcaatcagccgccttttcgggcggtttttgttttatttgaaaacattggcagcatgctttcagctttttgtgaataattctgtttttccctatgcaaacggctgattttttgttatactatatatgattggagaagaacggtacagtccgttcgctgaaagggagtgacctctttatgaaacttacaaaagagagtattaaacataacgtggcatggaagggttatcgtctgccgcagtacgacattgacgccgtgcgcgaaaacacccacaaggcaccgacttggctgcatttcggcgccggcaacctgttccgcgccttcccggctgtactggcgcagcgcctgctgaccgccggtctgtccgacaccggcattatctgctgcgacggctacgatgaggagctgatcgaccgctgctaccgcgcctgcgatcatctgtcgctggttgtcaccctgtattccaacggcacgatcaacaaggaagtggttgcgtccgttaccgaaagcctcaagctgagcgaggacatgctgcgcctgaaggacattttcctggcgccgagcctgcagatgatcagctttacgctgaccgagaagggctatatcatccaggatgacacccgtgagttcctgccggactacaagcacgaccgcgagaacggtccggaaggctgccagtccttcttcggcaagctgaccgcactgtgcctcgagcgctgccgcgccggtctgtctccgctggcactcgtttcgctggataactgctcggataacggcacccgtctggagcgtgctgtccgtcacatggcacgcgcatggcagagaaacggctttatcaccgaggatgagtattacttcctgctcaagaagaataccttcccgctgtccatgattgataagattaccccgcatccggataaccgcatcgcagacaagctggcggctgacggtctggagaacgcaaagccgttcgtaaccgaaaagggcacgcacgcggctgtttacgtcaactccgaaagcccgcactacctgctcatcgagaacgcattcccgaacggtcatccggctctcgagcagtgcggcgttatcatcacccgccgcgacatcgttgagaagtctgcgatgatgaaggtaagcacctgcatgaacccgatggataccgccctcggcgtattcggctgcatgctcggctacacccgcatcagcgacgagatgaaggacaccgagctggtcaacctcatcacgcgcctgagcgagcaggaggcaatgccgatggtagccgaccccggtgttatcgatccggaggcattcctgcacgaggttctcggcgaacgttatccgaacccgttcctgcaggattccccgcagcgtaccgcaaccgatacctcgcgtaagattgcgccgcgcttcggtactacgctgtacgcttactataactccatgctgcccgcacaccgtgctaccaagctgatttacattccgctggtactggccggctggctgcgctatctggaaggtgtggacgataacggcagcgagttcaccctcagccccgacccgaatatcgagcatgtccgcgcgctgatgggcaacccgaagctgggcgacgacgtaagcgaggctcagctgtacccattgctggcaaaccgctactacttcggtgtcaacctgtttgagatcggcgtaggcgagaccgttgtccgcatgtttggtgaaatgaaccgcggcccgcacgctgtccgcgagacgctgcagaagtactgcggcgaggagcaggagcaggagtggattttctcttaattaccgaaaaaccgtaagacaaaaggcgaaccgtaaggttcgccttttttgctataattgaggattgagaatggagaatggagaatgagcgcagcagggaagcgatggtaaagaaaacggcggaccataggtccgccgtttctgggtgttgcagcaaattttaattgcacgattgtgttgccattatcagtctgtgccttttcgcatagaaaataaccgcccctgaattggtattttcaagctatccaagtttttaggaacgaccgctcttgccagagagccggtcattgttgcaactacaaggttagtatatcgaatatcatattattttgtcaagcaaaatagtaaattatacgtttaatcggcgtttgttatccgctagtaaagtttacaatacctttccaaagagcgtaaagcaagtcctcaaatgatgcctgcgggttatgaattgcaatccatacaaagcctgccgataaaaggacagtcaccacgattattacccaaaaacaataccatctctgtttaggtgtcatagtatttccctcctcagtcataacggtaagtttcgcctcggggagttttacatctgatatctatatagtaacagatattcacgatttgtaaagggattttgcacagaagccggtgcattatttttgtccggcggctacccgtaatcccggcgcatatctgagccatttcccgctcttgagccgcaggaagaagcagatcgaccggcacagccagtcaccgatcatggcaatccagatgccgatcgcgcccatgccgaagtgcaccgcgagaatatatcccgcgacaagccgcaatcccagcatggagataatcgagcacaccatcggataccttacgtcatttgccgcacgcaggatattcggcatggcaaacgaggtcggccacaggaagatcgcgcagccgttgtgaatcataatcagcgtcatgccgagcgcaagcgcctctgcggacacgctgtaaatcttgagaatgagcggcgtgcacgcgatcgtgacaaggcaggtgctcgcggtaacggcgtaggtgatcatcatcagctttttcgccatgcggcgcgtctgcggctcgtcgcccgagccgatgcactgcccgataaccgtaatcatcgccagactcatcgcctgacccggaatgacggctacggcatccaggttattcgccagcgcattcgcggtaatctgcgtcgtgccgaacagcgagatcatgctcacgacgagcacgcggccaagctgaaacaggctgttttccagtccgttcggcacaccaatctgcagaatgcggcggataagctccttatccggtcgaaaccgctgtccgcgccgcagagagaccgtgtgctcagggttcagcagcagaatcgtgatagcgacagccgccgtgccgcgcgacagcacggacgaaagcgctgcgcctccgacgccccacttgaacacgaaaatgaacagcgagttgccgatgaggttgacgatgttgatcagtcccgcaatcagcatggagatacgcgagttgccctgtgcgcggaacagcgccgcaccggcgttgtaaatcgccagaacagggtaggagaacacgctgaccgtcaggtaggtgagcgcgctctgcatcacatcgtcctcgatcgtgccgaacagcaggcgcagcagcggtgcgcggaacagcatgacgagcgttgagataatcagcgcaatgacagtaacaactaagtacagctgcttggaggcatcgcacgcacggtcgttctttctcgcaccgagcagctgcgcgaccacgacagcgccgccggtcgccagtgcggaaaagatgttgatgatgagcacgttgagcatatcgactagcgatacgccggaaaccgccgcttcaccgaccgaggagaccatcatcgtgtcggccagaccgaccgtgatggcgagcacctgctcgataacgagcggcaaaatcagctttttgagtgcggtatttggaaataactctttactcgtaaaaaatacacctcgaatcaaagaataacgcggtacgcttctatcagcctctcgagcgaccatgcggcgttcgcgggactggtggagggcagctgcgtgacgggcacgccggttttcggctcgatgagtttgcggtacagctgcgccgacttgccgccggtggcaaaaatgcgcgtaattttgctctcgcggagcaggcggcctatgtcgttcggctcggcgttgcggatagacgtgtcggacgcgcccgcaatatcgcatttggcgatggtgtcccacagcgccacatgatgccgcaggcacatcgcgcgcttgtcctcaatggagaccggcacctcctcgccaagcacagccgccagcacgcgccagaaccggttctgcgggtggccgtaaaagaacccgacctcgcgggatttcgggcttggaatcgagccgagcagcagcacgcgcgactcgctgtcgtacagcggcggaatggtgtgaacgatggtttgcagttgcatggatcagtcctccagtacggaaacaaagctgcggaacgcgctcggcagcgcataagcgtcgcgcagctcggcaggtgtgacaaaggtgagagcgggtgcaggtgtgtccagttcgacatacacgccgttcatgtgccactccacatgggtgaaaatatgtttggcaggccgcagagagagcagctttcgcacgctccagtccatttcggtgagcgccgcgcgcagctcgtccggcgagagatggccatcgagcgacggcagctcccacagaccggcgagcagaccctttttgggtctctgccgcagaccgacaagctgaccgcagcgtacaacaagcacggtgcggttttccactctccgcgccttttttgcggctcggagcggcagcacagccgcgtttccgcggtgaaagccctcgcagagatgctgaatcgggcagtcgtcacagcgcggcgcgccgttcggcagacagacggttgcaccaagctccatcagcgactggttgagatcgccggaacggtcggacggcatgagtgcggcgaaccgttcgcgcgtctgctttttgaattttgcgtccgtgatcggcgtgaaatcgttatccagccgcgccgccacacgcagaacattgccgtccaccgccggaacgggcagtccgaacgcgatagacgccaccgcgcctgccgtgtactcgccgacgccgggcagagcaagcagcctgtcgtaatcagcaggcagttcgccgccgtattcttcgcacagcaggactgctgcacggtgcaggttgcgcacgcggctgtagtagccgagcccctcccagagcttggtgtaaacggcctcgtccgccgctgcgagagcgggaatatcgggcagcgcgttcatccaacgggagaagtagccgcgcacggcctccacgcgcgtctgctgcagcataatctcgctcacccagacgcggtagggagtaggctcagaccgccacggcaggtcgcggtgaccggcgtcataccagctcagcagcggctgcacgatggccttgcttaccccgctcaatatttcatgtcatccagcgtagcgccggtgtagaacatggtgaaggtcgcgtcggcaatgtgcttgccctcgtcgtcgtgcacctcgaccatgtagaccgacaccttgcggccgcgcttgcgctcgtacgccacagcggtcagctttttgccgcagcggcccggacggtagtagtggatagtgctgtcgagcgtgacggccaccgtgccctgagacgccgccgcagagccggccgcaatatcgcacagcgcgaagatcgtgccgccgtgcgccatgccgagcggattgagcagctcgggggtcaggtcaagctctacggttgcgccgccgtccttgtcgagcgtcacaacgtgcatgtgcatcagtttgtttaagccgccggcttcctgccgcagcttgaggatttcttcgatggtcaaggttaggactcctttatatattctataatcttttgataaacaatggtttttcgccttcgaggcgaacggttcttgcctgcgcggcgggcgcacaagagggtagacaccaaggtttctaccctcttgagaatcacccatttccttagagggcacggcgcagattgccgacatgtgaccgctgcgaaaatggggtacggcagaggagtttttcttccgcagagacgcactgcgtgcgctcatgtatccgcatattcgcagtgtcggataacgtactgcgacacatgtggtttcatctccgcagggtgcggcataacagtgccgcacaattctttagcgcgttatgatagacagggcctacgcaggataacttgcaccaaacgcttaattcgcaggtgccgtgcggtataacgtgttaaagagttgcgcaacacgggtatgttgcgcctgcgtagagttgcccgcctgtgtagcagtacgttatctgacactgcgaataggctgctcatgaggacggacaccgaaggtagtccgtccgtagcagaggaaaaatcctctgccgttctccttttcgaagcggtcgccgctctccgattttcgccgggctaacaaacaagggaaaggtaggagttcaaagaggaagggaaaccgcaggtgtcccttcctttttgccccccgcggcgggcgccgcagtctcccgcgctccgcagagcgcaactccccgctgaggttcagcaaaaaactcccgcccgttaggggcgaacccgcttacgcagttcgggtgccccggttagccggtgctgaaaaaactcccgcccgttaggggcgaaccgcctgcgcagttcgcgtgccccggtcagccggtgctgaaaaactgccgcccatcaggggcgaacacgcctgcgcagttcgcgtaccccggtcagccggtgcaggataacaggtgaaatctgcgatactactctattttattataaaatgcacccgctcctgcgtcaagcgcaaccgcccggcgaagcctgacgaatttttctaacagccgtcggattacacaatccccaatatgtagttaccaatcggaaacaggacaacaaaatgcagggaaaagtgccgaaaatacaaagtgagcctgtcgaaatgcgtcgaatatgactgttttctgtactttacaaacggtaatacagcgagtataatataaatatatattttatagttgtgccttctgcggcacaacgcagacggagaatgttggaatgagtgatttttcgcgcacgcttgcgcttctgcgacgggaaaagaaaataagtcaaagagcggcagcgggcgacctcggcgtttcgcaggcgcttctcagccactatgagaacggactgcgcgaacccggtctgtcttttgttgtgcgtgcggcggattattacggcgtgtcctgcgactacctgctcggccgttcgatggcgcgtgacggctctgctgtgcctgccgagcgcatggagggaacggacaccgagacggagcacagccagatcgtgcaggcggcagccctgctgctgcaggttgccgaatcgctcgagagcaagcagctttcgcacgagatcgagtcgtatttcgcggttgcgatctacaaggtgtaccgctatctctacatggccgacccggccggtgtggatgcggtgttccgcgcgccgcaggatcgcttcgagtacctgtgcgatgcccgcatgaaggagcatgagctgaaaatccgtctggcggccaacggcgaggaaggctgcggtctgacgcaggagaatatccggcggatgccgctcgccccgagcgagattgcacggcgttatccggatttgtcgagcgcactgctgactgttctgcagcaggtgtcggattcgatcgaccggaaaaataaaatgcaataatttcggataaacctattgacaaatacaccggtgtgaggtatactaaacaagtcgctgagacaagacgacttgatgaaatgctggtgtagctcagttggtagagcagctgatttgtaatcagcaggtcgggggttcaagtccgtccaccagctccaatcaagctggtaattgaatatggaaggtttcccgagtggccaaagggaacagactgtaaatctgtcgtctatgacttcggtggttcgaatccaccaccttccaccaaaacagaaggacattccaaaaggaatgtcctttttctgttttggcggaaggtggttgtggattcgaaaggtggctcttagaaacagcccagtgggctgtttcaaccaccgtggctttgccgcagcaaagcgaatccaccaccgaacgggcaggcaggcgtgtagcagtaagatgataggactgcaccagattgcttaagttagacacacgccctaaacggagtgtcggctcttagaaacgtgccggtggcacgtttcaaccggcgtggctttcaccgcagtgaaagcgaatccaccaccgaacgggcaggcaggcgtgtagcagtaagatgataggactgcaccagattgcttaagttagacacacgctctaaacggagcgccggctcttagaaacgtgccggtggcacgtttcaaccggcgtggcttgcccgtaggccgacaacctctaaaatatttaatggttgttcccgcagcaaagcgaatccgccaccggacgggcaggcacgcgtgtggcagtgcgaccatggcggcaataaccaatcacggcaggcacgcgcccaatccgaagggaagaacagattgttcggtagtgaaatcaacctgtacaggctatttggaacgatatattgccgcttgcgacgttatcccgtaggggcgcacagtgtgcgcctagacagcgcaaaatcatacggttcgtgggcgaacactccgacacgctatgagccgcctgcggcggttgctcgctggacgtccactgcggtgggtgtgttcgcccctacggttcagctggtgcagatgaatttacaaacggtgtgccgaggtcgtacctcagggcaccttctcttgcggctttgccgcaattcaccttggcacaccctgcggaatagcttgtgcacaccgaaaatatttccccgagttgaccactcatggtcaattttttatataatccggcgtatagatgagggtagaagctatgccagtcaaggcgaatgcagcggcacatcagcgggcgtgagaaccacaacggcggcgacctgagccgatgaagctgctccatcgaacagagcaaaaccagccttgttgggtatcaacagggcctattcccatgcccatcgttttttctcgcccggaaaacgcgatttctcgtccggaaaacggcatttctcgtccggaaaatccacagagcagagaagagcagaggacagaacagaagagaagagcagagcatagcagaggacagcagagcagacaaaattgagcatggaaaatgattctgtctgacctgatcctgactgacgaaaagagattttctaaattgctttctgcaaataaaaaaggacctccggtaaaaccggaagtccttgatctatcgttttggtaacgagattacttagccatggaagcaacttctgctgcgaagtcgtcaaccttcttctcgatgccctcgcccttctcgaaacgaacgcactttacgagcttgatctcgccgcccagctccttggcaacagccttgatgtgagcctcaacggaaaccttgttctccttaacgaaagcctgctgcaggaggcagttctcctcgtagtacttgccgatacggccgtctaccatcttgtggatgatctgctccggcttcggcttagcagcggtcttgttctcctcgagagcctggatcaggaggatctccttctcctttgcgagggtagcctcgtcaacgtcggacttgtccaggaaggacgggttcatagcagcagcctgcatgccgatgtccttgcccagctccttaacagtagcgttgtccttcagaccctcggaaacttccagaccaaccagaacgccgattacgccgcccatgtggttgtaagcaacgttaacggtggagttgtcgaaacgctcgaaacgacggatctgcaggttctcgccgatggtcagaaccttctcctgcagagcgtcctgaacggtgccttcgcccatcttgcaagccttgagagcctcaacgtcagccggagcgtccttgataacaacgttagcaacgtcggcaacgaactgctggaagtcagcgttcttagcaacgaagtcggtctcggagtttacctcgatgattgcgcctacgccgcactcatcacatacggtagccttgaccagaccctcagcagcgatgcggtctgccttcttggcagccttagccaggcccttctcacggagcagctcgatagccttgtcgaagtcgccgtcggcctcggtcagtgccttcttgcagtccatcatgcctacgctggtcatttcgcggagcttctttacgtcagcagcggtaaaagccattttattattcctccaatttatgattttacgatgaaaaaaacgtagggcacaacgaacaccggcgcgccgggtcgtcgcgccctacgaacaactcactgaatgttatattgagttatgaattactcagcctttgcgtcagccttagcctcaacctcgagctgctcgccctgcttgccttccagaacagcgttagccatggtctgggagatcagcttgatagcgcggatagcgtcgtcgttgcccgggataacgtagtcgatctcgtccggatcgcagttggtatcaacgattgcaacgatcggaatgcccagcttgcgtgcttctgcgatcgcgttcttctccttgcgggagtcaactacgaacagagcgcccggaagctccttcatttccttaacgccgccgaggtacttctcgagcttagcgatctcgagctggagcttgataacttccttcttcgggagcagatcgaaggtgccgtcagcctgcatcttctgcagctggttcagacgagcgatacgggtacgcatggtcttgaagttggtcagcatgccgcccagccaacgtgcgttaacgtagaactgaccgcaacgctcagcctcttccttgattgcgtcctgtgcctgcttcttggtgccgacaaacaggatggacttgccggaagctgccatatcgcgtacgaagaagtatgcttcctcgagcttctttacagtcttctggaggtcaatgatgtagataccattgcgctcggtgaagatgtaggtagccattttcgggttccaacgacgggtctgatggccgaagtgtacgccggcctccagcagctgcttcatagaaattactgccattttgtttttcctccttggtttttcctccatccctgatcatctgacagcggcaacagaacgagcgtcccatcaccgaccgctttcatcacgggatgtgtgaattcatgctatgatagtttacaccaatgggagggggatgtcaagaggaaagttgaaaattgaggatggaaaatggagaatggagaatgaacgatacgctttacggggattctgcggggttggattacattaaatataccgtatcgaatgattggaatgctttgcggtcaattaaatgaatatcgtagggtgcgacaaaaccggtaatgaaatatttttccctgcataaaattatggcaggaggggattcctttgcgattgggttttcgtcacaccgcgtttcaggcggtatgcacggttttggttttatgctttgtgctcggactgcttgagcgtgccgacacggtgcagccggtattcggggaggacagcgtgcgcgtgccgattctaatgtaccacagcattctgagggacagcgcacggcagggcaagtacgtcatctcgccggcggttttggcggccgatctggacgccttgcaggagaaggggtataccgccgtaacggtgagcgatctgctggcgtatgtacaggacggcgcagacctgccggagaagccggtgatgatcaccttcgatgacggctactacaacaactacatttatgcctatccgctgctcaaacagcgcggaatgaaggcggttgtgtccatcatcggcagccagaccgcgcttttcaccgacaacggagaggaaaacgcctactggtcgcatttgcggcttgaccgcctgcgcgaaatgcaggatgtgtttgaggtgcagaatcattcgtggaacctgcacgagtacggcgaacgccgcggctgtctgcgccgcagaggcgaggacgaaacgcgctacgagacgctgctccgcgaggacaccgaacagacgcagacactcatcacggacgccggactgcccgcgccgacctgctatacctatccgttcggtgcgtgctccaaagagagcgaaacgctgctcaaaagcatgggcttccggtgtacgctcgggtgcgaggagcgcgtcaataccgttacacgcaatccggactgcctgtttgagctggggcggttcaaccgtccggcagggcagagcacggaaagtttcctgcaccgcgcgttaggagaggattaaatgcagaataccatgcgattttccgagctgcactgccgtgaggtgatcaatctgtgcgacggagcacggatgggcgaggtgagcgatctgctgttcgatccggtctgcggacagattaccgcacttgtcgtgcccgcgcaaagcggcattgtcgggctgttctccaaaaatgactgcgttattccgtggggatgcattgaaacccttggggaggactatattctggtccggtacagaccgaaatagggaggaggtaggagtgggtgatgataaacgttttccgtagggcgggctgccctcagcccgccgttcgtaacggcatgcagaggatatacgcggcgggctgagggcagcccgccctacggtataggtaaatcataaggaaaactcctcactcctacctcctaacttctgccttgcacaggtaaaagaaaaaggcggacaaccgtccgccttttggctcaatccttcttatactttgcaacgccctcggtgtagaggttgccgccgaccgaatcctgcgacacgatggcggagaaattctccacggtgagacgcttgaccgactcgcagcccagctcgtcatatgcgatgacctcgacattcttaatggatgccgccttcgccgcgcctgcgccgccgatggctaccatataaaccgcgccgttgcgcgccattgcgtcctgcacgccctgaccccgcacgcccttgccgatcatgcaggcaagacctgcatcgagcagacgcggtgcgaacgggtccatacggccggaggtggtcgggccgaccgagccgatgacctgacccggctttgcgggggtcggtccggcgtagtagatcgccgcgccgtcgaggtcgaacggcagcttgtcgcctgcgtccatcgcggcaacgatcttcttgtgtgcggcgtcgcgcgcggtgtagaccgtgccggtcagcgttacggtgtcgcccgcacgcagcttcggcgccatttccttgagctgttcggtttttaaatcgtagtgtgccatgcttattcctccgttttcgggcgcagattattcagaacctcacgcagtccgttttttgtcttgtccggctcgggatggggcgcctcgccgtcctttttgccgagcgacgcgctgatcttgtcaatttcaccgagcacctcaccggccttgcgggccaactcggcggattcctgctggttgcgtgccagcacggtgcggtagttctccttggtggcatccagctggcggcgcacctgctcgatggtctccatcgacttgcggcgcagcttctgcagctcaaccttggcatcctcctcgatctgcttggcgcgccggtacgcggaaagctccatctcggcgatcttctctctggtcgcatcgtattcgccgcatttggccgacagcttggcgttctccgaggtcagccggtcgttttccgccgcaagctgcgccgcgcgggcgttctgcgcctcgatctcggtcgcctgaagggaaaaaccgctttcgatctggtccagctgtgcgcggattttatcggtatccagcgtcatttcgcccagccgttcgagcagctcggcgttcttcgcggtaagcgcctcgttctgcgtgcgcagctcgttcatcgcggactgagcctcggtcagctgagagcgcagctcggcggtctcggtgtagtatttcgtgtcggtttcttctatgtaatgcattacgtcctcgcggttaaagccgccgaagatggcactgcggaatccacgggtttgctcgtccattgcagttcctcccacaataatcttatattagtatagcaaatcctgacgataaaggcaataaaaagagtgaagagtgcgtggaggcaggagagaatattggtttaccttgtttctccgtttcaatattacgatgaaggtataccgcagggtgtcacaattcaccttgccgcaccctgcaggataccggttcgaaatgattacacgatgcgaccattttctcgcaatgcacacacaccgcgggaaatgcggattctttgtacatattgaacagaatgatataataatgtaaggtaatgtgcccggatatcttgcaatcaaaaatggaaagtgatattataaatctatcttgcaaaaacgaggaagatgctcaatgttagaattaaaagatttcgaggcagctgcggaccgactgaaaaacgtcatccacaacattccgctgtctacgtcctgcaccttctccgccatgaccggcgcagaggtttatctgaagtacgaaaaccagcagaagaccggctcctttaaggtgcgcggtgcttacaataagattatgaagcgcttcgctgagggcgacctgcacgccgttgttgcgtcctctgcgggcaaccatgcacagggcgttgcctttgcggcaaccgctgccggtgtaaaatccaccatcgttatgccgcgttccgcgccgatcgccaaggtttccgcaacccagggctacggtgccgaggttgttctggcgggcaacatttacgatgaagcctatgccaaggcgtgcgagatctgcgaggagaccggcgcagagttcatccacccgtttgacgatgaggatgttatggcgggtcagggcaccatcgcgctggaaatcctgcgcgacctgccgggcgttgacatgatctttgttccggccggcggcggcggactgatctccggcgtggctgcctgcgcaaagcagatcaacccgcgcatccagatcatcggcgtacaggctgagggcgcaccggcgatcgcaaattcgttccgcaccggtgagcgcactccgtccgataccgtgcacaccatcgctgacggtatcgccgtaaagaccccgggcgaaaagacctttgagtatatcaagcagtatgtggaccgcgttgtcacggtttccgatgacgagatcgcttccgctgttctgctgctgctcgagcgctgcaagcaggtcgttgagacctcgggtgcggctccgctcgcggctgtgctcaacaacaaggtggatgtcaagggtaaaaaggtcgtatgcgtgctgtccggcggcaatatcgacgtatcctttattcacaagatcgtcgaaaagggccttatcacccgctgccgtcagctgaagttctctgtgctcatgccggatgcaccgggcgcactcgagcatttctcgcacatcgttgcacagcagaatgccaatatcatcctgttccagcatgaccgcgtacagacggacctcgagatcggcgaggcgattatccatgtcgtctgtgaggtcggcggtgttgaccacgccaagcgcctcatcgacaccctcaccgatgatggctataaggtgtttacttcgcagatttgataaaaatgcaatgaaattacagcgttccgcttggatagagcggggcgctgttctttttttcggaataatggaggatggaaaatggagaatggagaatgaacgctggggtttaaccttcttcgcattgcgatatcaccgtatgaaatgtataccgtagggtgcgccgaggtgaattgcggcgtagccgcaagagaaggtgccctggggtatgacctcggcgcaccatttgtaaattcatcggcaaacgcatacccgtaggggagcacagtgtgctcccgcgttatggttaaccgggtgcgtggccgttccctgcacaggcttcggtcgtgctgcgggcgaacaatgttcgcccctacggttacgcacgttacaatcgttagagacggtgcgccgaggtcggcgcaccctacggtatacatttcatgtaataccaaacccggagaaacgccgtaaaccgtatcgttcattttccattctccattctccattttcaattacgcctgcctcctcactcctgcctgaatcagtgacaaatgtaatattgacaaataaataacgatgtgctattatctcagcgtgataaggaatgaaaaaacaggtggacgttttatcgcattatttgccttaaaacggatagaataataaaaccacgcatacagtcaatcgcagaaaggaagcattacgctatggcagcacacatcaacgacgaaatgctgaacaaaatggacgcatactggcgggcggcaaattatcttgcagccggtcagctttacctgctcgataacccgctgctcaaggagccgctgaagcccgagcacatcaagaagaagatcgtcggtcactggggcacggtgcccggtcagaacctgatttacgttcatctgaaccgcatcatcaagcagtataatctggatatgatcctgctgtccggtccgggtcacggcggcaacttcttcgtggcgaacacttatctcgagggcacttacagcgaggtttacccgaacatcagcgaggacaccgagggcatgaagcgcctgttcaagcagttctcgttcccgggcggcattgccagccacgttgccccggagaccccgggctccatccacgagggcggtgaactgggttattctctggcgcacggcttcggtgcggtgctggataaccccgacctgatcgcaaccgtggttgtcggtgacggcgaggcggagaccggcccgctggcaacctcgtggcacggcaacaagttcctcaatccggtgacggacggcgttgttctgccgatcctgcacctgaacggctacaagatctccaacccgaccctgctgtcgcgtattcccgaagaggagctgcgcaaaatgctcgagggctgcggctggaagccgtatttcgtcgagggcgatgagccgatgaaggtacaccgcgcactggcggacacgctcgacaccgtaaccgaggaaatcctcgctatccgcaagcacgcccgcgagaccggcgacacgacccgtccaatctatccgatgatcgtgctgcgcaccccgaagggctggaccggcccgaagaacgtggacggcaagcagatcgagggcagcttccgcgcgcatcaggtgccgctgatgatggacagcccggagcacctgcccatgctcgagcagtggctgcgcagctaccatccggaggagctgttcgacgaaaacggcaagctgattcccgaactcaaggcgctggcgccgaccggcgagcaccgcatcggcgcaaacccgcacgccaacggcggtctgctcatgcaccagctgcgcctgccggatttccgtgattacggactgaatgttccggctccgggcagtgttgaggggcaggatatgatcgagcttggcgcttatgtccgcgatgtcatcaagctgaacatggacagccgcaacttccgcgtattcggcccggacgagaccatgtccaaccgcctgagccacattttcgaggtcaccgaccgcgagtggaacgccgatcgtctggacaccgacgaattcctgtccgcaagcggccgcgtgatggacggcatgctgtccgagcacatgtgcgagggttggcttgagggctatctgctgaccggccgtcacggctttttcgcaagctatgaggcgttcatccgcattatcgactcgatggcggcacagcacgccaagtggctcaaggtctgcaacggcctgccgtggcgtcagccgatcgcgtcgctcaacctgattctggcttccaacgtatggcagcaggaccacaacggctttacccatcaggacccgggtttccttgaccacatcgccaacaaaaaggcggatgttgtccgtctgtacctgccgcccgatgcaaactgcctgctcagctgcttcgatcactgcatcaagagccgcaactatgtcaacgtcatcgtggcttccaagcatccgcgtccgcagtggctgaccatggagcaggctgtgcagcactgcacccagggcatcggcatctgggagtgggcgtccaacgatcagggcgcagaaccggacgttgttatggcgtgctgcggcgagacgccgacgctcgaaacgctggctgccgtatccatcctgcgggaagagctgcccgaactcaaggttcgcgttgtcaacgtggttgacctgatgaagctgcagcccgagcgggagcatccgcacggcctgtccgacgccgagtacgacatgctgttcaccaaggataagccgatcatcttcgccttccacggctacccgacgctcgttcatgagctgacctaccgccgtcataaccgcaacctgcacgttcgcggctacagggaggagggcaccatcaccacgccgttcgatatgcgcgtgcagaatgatatcgaccgcttccacctcgtcaaggacgttctgctgcgcttgccgcagcttggcaaccgcggcgcgtacctctaccagaagatgagcgataagctggtgcagcatcagcagtatatcaccgagtacggtgaggatatgccggaagtccgcgagtggaaatgggacaaataattaggaatgagtaattaggaattagtaattacgcagcgggagaatcttccgcaggggcgcacattgtgcgcccttttcctttgtataggcataaaatgttgaaaagattataaaatggcagagatgcaaccgtagggtgcgacgacctcggcgcaccgcatgtaaattcatcggcagcggttatcccgtaggggagcacagtgtgctcccgcgttgatgttcaatggatgcgcgggcgaacaatgttcgcccctgcggttacgcatgtgcagacggtttacacggtgcgccgagtcggcgcaccctacggtaaggctttctatcacgtcaattactaacttctaattcctaattactaattactaattatgcttgacatgccgtctggttcgtgttattatctaactgtactaaaacacacagtacagttgatacactctcaaatcaacaaaaggaaaggaggcgcgtcaggtgattaaaatcgactatcgggatgcccgccccatctatgaacaggtggtggacggcattgagggactggctctgcgtggggcactgccagcggacacccagctgcccagtgtacggcagcttgcgatggaactgtcgatcaacccgaacacaatacagcgcgcttacggagagctggaacgccgcggtgtgatttacgccgcaaaaggacggggaaattttatatcggacaatgcagcggcgctgcgttcccagaggcttaacgaactgggtgagcagattaccgcactggccggtcaggcgcgctcactcggggcgaccgaggagcagctgcgcggctgggtagagaggaaaggagagagcgaaacatgattacggcaaccaacgcgaccaagcggtttgaggacatcacggcggtcgatcacatctgcgcggaagtcaaggacggttcggtctacggcctgatcggctcgaacggcgcgggcaagtccacgttcctgcgcatgctggccggcattttgcagccggatgagggcacggtgcagatcgacggagcggacattttcgagaatattgcaatgaaggaacggtttttcttcatctcggatgagcagttttttttcccgaacagcacaccgaaggaaatgaaaaactactataagcgcttttacagcaaattcgatgaagcgcgctaccgcaagctgatgaacggctttggtctggacgaaaaccgcaagctgcggacgttctccaagggcatgaaaaagcaggtttcggtcatctgcggcgtatgcagcggcacggactacttattctgcgatgagacgttcgacggtctcgacccggtcgttcgccagacggtaaagagcctgtttgccgaggatgtagcggacagaggtctgacgcccatcatcgcctcgcacaacctgcgtgagctggaggacatctgcgaccatgtcggtctgctgcatcgcggcggcatcctgttctcgcgcgatctggacgacatgaagctcggcatgtacaaaatgcagtgcattttcccgaatccgctgccggattccgcgtgggaaggctttgacattctgcacaaggagcagcgcggctcgctgtacactattacggcgcgcggcagccgggaagagctgctcgccagggtgaatgcgctgaacccgaccttctgcgaaatgctcccgctgacgctggaggaaatctttatcaatgaaacggaggtggcaggctatgatgtcaagaaactcctgttctaagggtctcgtgcgggattgcatgaaacgcaatctgtgggctatcgtgctgtccacggtgggattctttatggcacagctgctgccggtgattatgacggcgcagcacagcctggcggaacataagcaggatctggccaatctgagtgcggccgatgccgcggcaagctggcaaggctatgtggtgagtgtcggtgagatgctcggcggacagaatatgtttgtcaagctggccgtcatcattctggcggtcacctgcggtgtgagcatgttcgcgtacctgcacaatcgccgcaaggtggatttctatcacagcctgccgatttcgcgcagccgcctgttcgcggtggactacgcgaccggtgcgctgtgtgcgctggtgccgtacctcgtgctgcatgcgctgagcattgtcagtgcatgtgcgatgggcttcggtgaggtggtcaacgcatcgctcatcggcgtgatcgcgtccaacgtcattttcttcttcctgctgtacgcgatggcggctgttacgaccatcctgtgcggcaacacggttatcacgctgctgctcggtctgtgggtgtacttcggaccgacactcgtaaccgcactgtggcagggtctcaagagcatgttcttccagacctatgtgatggatgcttccatggcttcgctgctgttctgcaacaagtttgcaccgctgattcagtatttcggcgtaaacggcacgaaaatgcatagctgggcaggggcggtagagcctgtctatacgatggattacgccgccgggctgcaggagccgagtgctatcggtctgctgatcggctatgcggttgcggcgatcgttatcaccgcactggcgctgttcctgttccgcatccgaaagagtgagcgggcgggcacggcactggcattcaacccgatcaagctgcccgtcaagattattatctgcgtggttatgggtacggcgttcgctgagattttcaaaatgctggtctacgaatccgagctgtggttctgggtcggtctggtgctcggcacggtcattttccactgcgtggtggagattatctacgcgttcgacttccgcgccatcttccgcaagccgctgcagctggttatcatccttgcagtgctgtgtgcgggtctgctgaccatgcagtccgacgtgttcggctacgacaagtggctgccggatgagggcagcattgcagcggcagcgccgatgggttacgtcggtgaatcggcactgctcagtgagccggaaaacatcgcggcagcgcggcagctggcggcgctcggcgtggaaagcctgaataatacggatgaaaatgcacagaaggagtgcatcaccgtcaccttcaagctgaagaacggcaaggtgaagagccgttcgtatgagctgccggccacagacgaagtgttcacgctcaaaaagcagatttaccagtccgcagagtacaagcagaaggcgtggtcgctgtttgcgctcggcgaggtcaacgagggttatcaccgcaacattgttttctacaccaacggtgacggctacaacggcgtcggcacactcagcgactcgcagaaggcgcaggagatcattgacacgctcaaggcagaggcgctgacccacaccgatgacgccatgccggtgctgcgcatggaattctcgcagcagaataacgacgattattacagcgagggtgccgtatgcgtgaccgacaaggacgtaaagacgcttgcactcatcaaaaagtacacaggcattgtacccaaggccatcagcgcggaaaacgtaaagtcggttgcgctgagcatctatctgccggataaagactgctggcagggcgtgcaggtgaccgaccgggcggacattgacgcgctgctcaagaatgcggtcaacattgacgcaatgaatctgtacggcagcgatgcgatggcgtatggcattatgcagcagtttgcccgcagcaacgtatccgtgacctacacggacgaaaagggcgatgagtggaacgcaagcgcaggctacaccgaagagggttatccgaaggatatcatcgagaaataccgtgcacaggccgagaaggacgcggaaaacggcgtcgagtctgcacaggacggtgatgttgcctatacgacgacagtggctgtcggataagcaagcgcggtatcatctgtttccactcgggctgttcctgccgctgttctggcagtggttcgagcgggcagcaccgcttgcctgctggatcgtcatcatcgcggcaagtacaatatccgatctgctgattctgtggtaggagacagcgggtcgcaggatagagagtaatatacggaaaacaggcacaccgagaggtgtgcctgttttggggttaacgggtgaaaatgctcgtaaaaatgaaaaacgccgtgttggcgttgaattgacggggttcgacagaatatgatataatgcagatggacgctgttgcatagtagcggtcagacccacattccttcccgtggtcagcggcaggaaggaggtggcgcgcgtgcagaaaaaggcttggaaactccttgtgtgtgcagtaatcgtgctgtacattttctgtataaaagcgcattgaccgctcggattaggccccggagcggtcaatgacttttagttgttgatcagttaagggtctgactgctgtgacagcgtcccttgtgttcattataacatatgcttgggttttgtcaagtgatgaaaccggagcgcttgtttggctttcggattgggcgcgtgcctgccgggattggctattgccgcccatggtcgcactgccacacgcgtgcctgcccgtacggtggtggattcgctttgctgcgggaacaaccattaaatattttagaggttgtcggcctacgggcaagccacgccggttgaaacgtgccaccggcacgtttctaagagccggctttcgaatccattccacctgacaccaaaaaagaaccgatactcgaatgagtatcggttcttttggtggaaggtggtggattcgaaccaccgaagtcatagacgacagatttacagtctgttccctttggccactcgggaaaccttccatattcgattaccagcttgattggagctggtggacggacttgaacccccgacctgctgattacaaatcagctgctctaccaactgagctacaccagcgttttgtcaagccgtctgtctcagcgacttatatataatagcatgcaaagcgcgaattgtcaacagctttttgcaaagttatcgaaaataattgtaaaatcctgtgcatcgctattaagaaaagggcggacacaccgatccgcccctgcgtacggattaaacgaacacattttgcaccaacaccatgtaaagcaccgtgccgacgccgatggacagcaggttattatgcttccagatgtgcagcagcgccgtgatggcgatgcagagcagctccgggataccgtgcgtgcccgtcacccagccgacgtttttcaggcagtacacgaccagcagcgcgatgactgcgggcggcagggtagagccgagatagcggatgatcagcgggatgggcttggagccgttgaacagcaggaacggcgcgacgcgcgtcgcaaacgtgcagacggctgccacggcgatcatggcgatagcataaacagttgtcataatcaggcgacctcctttgccagacggccgcgcatagcgaccagcatgacgcagattgcgagcatggcgggcaggatgaaattgtccggcccgaggatggcgagcgacacagctgccgcagccaaccccatcagtgcgggaatgtggcacttggtgctctgccactgctccacaaagataactgtgaacagcgaggtcatggcaaaatcaatgccggtggtgtcaaacggcagtatgccgccgatgatcgtgccgagcacgccgccgaggatccagtagctgtgatccagcatggcgatccagaagcgcatatcgcctgcatcaatgccctcgggcgttttgaccgagcacagcagggaataggtctcatcggtcagcgagaagatcatgtaccacttgcggcggcccatctcatgaaaagtctccagaaaggacagaccgtagaagatatgccggcagttgagcagcagcgtcatcaccgcaacggtaacaagggacgccttggccgccagaagcgacacaagcagatactgtcccgagcctgcgtagatgctcaggctgcagaagaaggaccagatcgatccgaagccgatatcgcgcagcataacaccgaatgcaaaaccgatgaacagatagccgcacagtacgggtatcgtggcggtaaaggcaggacgaaacgcctttttcatggaaatcacctacatactataagggtaaaagaaaagcgctctgcgaacagagcgctttggcatttcaacgtaaacgcacagatcgttaaaatcagatagcgcgggtaaccttgccggaacggaggcaccgagtacatacgttgatatggcggggagtaccatcgaccatagcctttacgcgacgaacgttcggcttccaggttcgattggaacgacggtgagagtgggaaacctgaataccaaaggtcacacccttattgcaaatatcgcactttgccattttcctgcacctccttctttcgggcattgcatagcagatattatattaccacatgtatagaatgaatgcaagcatttttttcagaaaaagagaaaatttcaagttttcctgcggtccgtgcggaaatcgttgaaaataacaggaaaatagggtataatacaactatatctactttatgtattatactatgtattatacagtaataaaacagcagagtaaagaggatatagaatacctgccacagcggaagggagcattatacttatgcagttaaaagaattcggtgtcagcttgggcgatctgatccatgaatttaattttgaggtcgtttacggtccggagggctttgaaaagaccgagatcaccaaggacgacgtaaaccgtcccggtttgcagctggcaggattttttgattatttcgatccgaaccgtatccagatcatgggcaaggttgagtccagttatgtagagggtctgtcgagcgaggagcgccgcagccgtttcgaccgtctgttcgagactggcatcccggtgctgctgctctcgcgcaatattgacgtatttccggaatgccttgcggctgcacaggagcacggtgtgccgatcctccgtaccaacgagtttacctctaccatcatgagtgtgatcgtcgccttcctcaaggtaaaacttgcaccgcgtgttacgctgcacggcgtactcatcgaaatctacggcgaaggcgtgcttctgctcggtgactccggtgtcggcaagtccgagaccgcgatcgagctggtaaagcgcggccaccgtctgatcgcggacgacgcggttgagatcaagcgtgtatccgacaagacgctcgtcggtacggcgcccgaggttatccgccactttatcgagctgcgcggcatcggcatcgttgacgttcgccgtatcttcggtatcggcgcgatcaagatgaccgaaaaggttgagcttgtcatcaacctcgagccgtgggaggacggcaagcagtacgaccgcctcggcatggacagccagacgacctccatcctcgatatcgcggttccgagcctgaccattccggtaaagcccggccgtaaccttgccgttatcatcgaggttgcagcgatgaatgaccgtcagaagaagatgggcttcaacgccgcgaaggagctgcaggagcgtatgctcaagcagtacggcaactgataaaaggtaaggcaataccgcataattgaacaagagtgatttgcgagtaaattttgcgtactgacgaggcacagttttgcggtaatacttaatgtattgccgtgaaacttcggcagcgcggacggaactcgcgtaaggaaccgaagccaaagtcaggacacaaaatttctgcaaagcaccgccgctttaattgtgcggtgttgccgtaagtaaggcagtatagcacaatgcaagcggtattgccttgaaaatttaataaaaggtggggatctttatgaaaaaagcagcggtattggtatgtatggcgtctgttcttctttcgggatgcagcggtgccggtggggaaaaggtgtcgcagacggcggattcctgcgcgcaggcggttgcgtccgagctggcgaagaccgactggacggcagtcagcacggatacaaacagcgaggacgctgcgtatgtgatggcgcatacggacacggtcgcgctcgacaggctgatcgcgtttacacttacagccgatggcgggccgagtgagggcgcgtgcgaggagctgcggagccgttttctggaatcgccgcacactgttctggcgtatctggtgctgatgggggatcagacggtatcgtcggacaacagcacaccggcggcagagttcatctgcgggcagattgcctcggcggatgccgcatggcatgacggctcggaggagtttgcacaggtaatggaatcgtgcaaagccgactatccggaaggaccggcggcggagctgctgagcaaaatggagacggcgcacgaagcctctctggaacgaaataaataaggtatgcaggcaaaagcgtgactttgacggtcatgtcttttgcctgcgttttcttttagggaaaacgactaaacagagtggatgttttttgttgcactcaccgaaagaaaaccgggaacaaaaccgcttccggaccgtctaactgggtataaaaaggaggtagttattatgatggagaaaaaacgaatggcggcattgcttgcagcggtgctgttcggcatgagcgcgattcccgccggagcagtgaacctgatcgacacggacacggcagcgactgactccgccgagcacgcggagcttgacctgtacggcgtgcgcgccacagtaaccgacaggcaggacggcgagctgaccgtcagcactgaaaccgcaggcacagttgtggtgcacattgcggagcagacgatcattatggacacgcagaccggtctgccggcaggcgcacaggatatcaaaaagggtgacgaggtgtacctctactgcggggaaatgatggcgctgtccgagccgccgcaggtgtatgccaaggcgattctggtcaatccgaccgacgaacacgagcccgcaagcctgctgtctgccgagcaggtgaagaggaacgcggacggcagtctgactgtgcaggcaagcgacggcggcctgacgctgaacattgcacggaatgcgtctgttacgccgttcggcacaaaaaacaaggcaaagcttgaggatatccgcatgggaacccggttttttgcgtggtatgatacgattctggaatcctatccggcacaggcgagcacggacaaggttgtgctgctgccttctgaggacgatacattcgccatcgtcattgagggcgatatggtcgctggcgaaggccgcatgacgaacggcgtggctatggttccgctgcgcctgaccgccgagctgtgcggctttacggtcaagtggaacgccagggaccgcgcggtgcacctcaccaacggcacggtgcagacgactgtgaccatcggtcgggatgagtatttccgcgcaaccgctctgccgaacgcggacggcatgagccgacccgaaccgctcggtgccgcgccctatatcgcgcagagcagaacgtgggttccggcggagctgttcggcctgctcggtgagcagcttgagatgcgcggggacgcgctgtatctcggcggggtgccgaatgctttcaccggagaagccgatgagacgaatgcgtttaacatcgtgtgcaaggacaagacgctcgacaaagggcgcatggaaaacggcgtggctatggtgccgctccgtgaggtcggcgaagccctcggctacactgtgacgtgggacatagagaaccgtcaggcgaagatgaacaacggcaaggttatgacgcatataaacatcggtgaggattcctatatccgttcggtgatgaacggcgacggcacggaagcaccggtttcgttcggcgcggcgccgtatttcgctgatggcaagacgtgggttccggcaaagctgtttgaactgctcggagaacgggttgaaatgaaggggaatgcgctgtatctcggtggaacggagaactaaatacgagaaaggatgaccgccatgaaacgaaagtggaaagcctgcctttgcatagccgcgttcctgctggccgtgctgccggtctccgcaagcgcggatatgggcccgaaaccgcagatcaccattcaggtgcagaatgcgccggacggcgattattatgttgacctgctcattccgggcgaggtacccgagcaatgcatcgacaatatcgagtggaatcatatcgaccgcgcgtctctgccgctggatgcgctggagcgcgaccgcatggacggctggcactatgccatgctggacggcacacaaccgcctctgttttacaagcatccggacaaggacacgtttgtgttcagctatttcggcacgccggacacgtttcgaattgcggtttatgacgattctcggcagaaagtaaacttttctgaggtgatgaagcgcacacagctgcagcagatattcacctgtgactttgcggataatacggtaaaaaccggaaatccgctgctgacatatctcaaacagtttgcgtcctcgctgctgccgacgctgctgcttgagggaatcctgctgctgccgttcggcttctgggacaggcgcaacgcaaggctgttcctcggcgtcaacatcggcacgcagctgctgctcacagtcgtaacggcggcctgcatgcggattggcatgccgttctaccggtatctggtatttgcgccgctggagcttgtgatttggatcgtcgaagccgttatttaccgcaaacggctgcaaactaagcgggaaacggctcatccgatcgtttacgcgctgtgcgccaacgcactgagcgcagccgcaactttgttcagcgtgcacatggtatttccgtggatttgagtgaaaagaacctgtcaatcgacaggttcttttcagtctgtcgaaaaagtcgtatagtccgcattttttcagcatttcgcgcggtagcgcgcatgaaatagcatttgctctgcaaatgctcaaaaagggggagcgtgtatcagcgcagcgcggccgagaagccgcgcaaggatagcgccccttttgaacttctggagggagaaagtttctatataggaactttcggacgactttggaacggcccacggtccgttcctgcttgtcggcgaaactgtagtttcgcgacagtctcaaaagaacctgtcaatcgacaggttcttttgcgtattccggcattttgtggtatgctatacggagcaaaggaggcgagcggccgtgtcagccaaagcatactatcatctgcccggattgtttgaattttacgagttttaccgtgcattcctgccgttataccgcgcgaatcgtgactggttttatgactggtgtgagattgggtccatttacggcgcaccggcggactgcctctggggagggggacgagcgggtttcggtgagtgcggcgcacgcgaagcgctggctctggcacaggagtacggcgtttccgcgcggctgacattcagcaattcgcttctgcgcgaggaacacctgtccgaccgcaaatgcaatgcactctgcgagctgttttcgcaggcaaacggcgtgcagaacggcgtaatcgtgcattccgagctgctgaccgactacctgcggacgcggtatccggcgctgtacctcgtgtcgtccacaaccaaggtgctgaccgattttgaagatttccggcacgagctggacagggaagaatttcggtatgtcgtgccggattttcgattgaataaacggtttgaggaattaaacgccttgtcgcaggtgcacaaagataaggtagaatttttgtgcaatgagtgctgctggttcgggtgcagtgaccgtaagcaatgctacgaggttgtcagccgcaaaaatctcggcgaggactgcgagcaccggtgtaaagcaccggatgcacagagcggctatcggttctccaaggcgatgtaaaatccggggttcatcggcgttgatgatgttctgcggacgtatctgccaatgggattttcgcagttcaagatcgagggcaggggattgggaagcgcgctgatcctcgagtttttgctgtattatatgacaaaaccggcgtatcagctgcgcgtgagagaagaaatttatctggataatatgttagacctgttttaacgcataagaaaagaacctgccgtaggacaggttctttttcgcataagcaagcagaaattacttgttcttattcttgatgtactcgtccatcgcagccgcagcgcgcttgcctgcgcccattgcgaggataacggtagccgcgccggtaacagcatcgccgccggcgaacacgccgtccttggaggtgatgccgtgctcatcgtcagccacgatgcagcccttgcggttggtatccagacccggcgtggtgtgacggatcagcgggttcgggctggtgccgattgccgcgataacgcagtccagatcaagcacaaactcgctgccctcaaccggaatcggacggcggcggccggatgcgtcaggctcgccaagctccatctgctggcacttgaggccggtgacgttgaagttctcgtcagacagcacctcgagcggcgcggtcaggaacttgaacacaacgccctcttccttcgcgtggtgaatctcctcgagacgagccggaagctccttctcggaacggcggtatacgatgtaaacctcgtccgcgcccatgcgctttgcacagcgggcggcgtccatggctacgttgccgccgccgactactgcgaccttcttggcgtggtagatcggggtgtcggcgttttccttgtacgccttcatcagattgatgcgggtcaggtactcgtttgcggagtaaacgccgtttgcgttctcgcccggaacaccgataaaggtcggcagaccggcaccggagcctacaaagatagcctcgtaaccgtcaccgaacagctcgtcgatggtctcagaacggccgacaacgaagttcagaacaaactcaacaccgaggtccttcagtgtgtcgatttccttctgcacgatagtcttcggcagacggaactccggaatgccgtacatgagtacgccgccggcggtgtgcagtgcctcgaaaacggtaacttcgtaacccatacgagccagatcgcctgcacaggtcagaccggccgggcctgcaccaacgatggcaaccttgtgaccgttggactccggctttactgccttttcggtgctgttctcgcgcgcatagtcggctacaaagcgctccaggcggccgattgctacagcctcgcccttgatgccgcgtacgcagtggcactcgcactggctctcctgcgggcagacacggccgcagacagcgggcagtgcggaggtttccttgatcttggcagccgcctcgaggaacttgccctcggcaaccagagcgatgaactccggaattttaacctgtaccgggcagccggtcatgcagggcttgttcttgcagttcaggcagcgctgtgcttcctcgaccgccatttcagcggtatagccgagcgttacctcttcaaagttcttattgcggacgtccggcgcctgctcgggcatcggacacttcttcggattcatattcggcatgattacttgacctccttcttgaacagattgcaatgctcttcgcggcgctctaccgccgcgcgctcctgtgccttgtacatggcaccgcggcgcattgcactgtcaaaatcaacgaggtgaccgtcgaaatccgggccgtcaacgcaggcgaacttggtctcgccgccaacggtaagacggcagccgccgcacatgccggtaccgtcaaccatgatggtgttcatggaaacgatggtcttgatgccgtacggacgggtggtctcgcagacaaacttcatcataatcatcgggccgatggcgataacggcatcgtactggttgcccgcgtcgatgagctccttgagcacctgcgtaaccagtgccttgcggccgttcgagccgtcgtcggtgacgatgtgcaggttggtgcaggcgttcttcatctcgtcctcgaggatgatgatgtccttgttgcggaaaccggcgatcaggtcaacctcagcgcccatttcgtgcagcttctttgcctgcggatatgcgatcgcgcagcccagaccgccgccgacaacagcgaccttcttgagaccctcaagctcgctcgccttgccgagcggaccgacaaaatcatgcaggcagtcgccctcattcagtgcgccgagcgccatcgtcgttgcgccgacctcctggaaaatgatcgtgacggaacccttttcgcggtcaaaatctgcgatcgtgagcggaatacgctcgccttctgcgctgacacgcaggatgatgaactgacccggctctgccttgcgggcaacgtgcggtgcctcgatcaccatcagcttggtgtttgcgttcagcgtttgctttttcaaaatctgatacactctttttcgtacctccttgcgattgtcgcatcgaacattttacattatactgtatcgctttaagcaacgcaagtgaaaatgcaaaatcatcagtaaaaatgggcggaattgatgaaaatacaccttgtttgtcaaaaaattaactgatttgacgaaatcttcacaaagccggacggcagtaaaacagcacaatgtcggttttcgaaacccagccgcaggccgtgcgcgtgcgtacatgacaccagccgttctgctcgcacaggatgagcaggcgcgcaccgcttgccgcactgccgacaatcggcgcggagcgaaccggatcggagtgcagcagaagaagcgcgccgcgcggctcggcgcaggccgtgcgaaacgcaggcgatacatatataacaggggacatagggcacctccttgtggttaatgcagactatgctgcaaaaatgcagagcgttaattggcaattaacgaattaccgattgcttgtgtcatgattgctgaaaaaataaatgcttttccatagtttttcgctgaaatttaggttgcattattatagaacgcgctgtataataatcagtgtttgaaagagatacccgttttgcacgggtcaaatcggaaggagttaacacaaatgaagaagttttccattgctatgctgagcatggtactggcaggttctatgctgctgaccggctgcggcggctccaagaccgctgattccagcagtgacgcacaggattccaccacctctacctctgcggacggcggcacgctgcgcatgggcactaacgctactttcccgccgtacgagttcgttggcgacgacggcaacgtacagggcatcgatgcggacatcgctgctgctatcgctgataagctgggcatgaagctcgagatcaccgatatggagttcgattccctgatcccggcgctgcagagcgacaccatcgacgtggctctggccggcatgaccgttaccccggaccgtcaggagaacgtagatttctctgattcctacgcaaagggcgttcaggtcatcatcgttaaggacggttccgatatcgcttctccggacgatctggagggcaagaacatcggcgttcagaccggcaccaccggcgacatctactgcaccggtgactacggtcaggagcatgtaaagcagttcaacaacggtccgctcgcagttgctgcactggtaaatgatcagatcgactgcgttgttatcgaccaggagccggctaagaactatgttgctgcaaacagcggcctcaagatccttgacactgcttacgctgacgaggattacgcgatcgctatcaagaagggcaacaccgagctgctcgacaaggtaaacggcgctctgaaggagctcgagggtgacggcaccctgcagtccatcgttgacaagtatatcagcgctgattccgcagcacagtaaatcaacaaacgcgtacaaaggaagagggacggttcagcgccgcccctcttttgcagtaaaatgaaaagaaagaggggatgacctgtgaacggtattacaatggaccagtggctgaaaatggtaccggattcggttgtcaatctgccggagggtctgcggaatctgctgttccagctgtaccagacctttatcgcagcggatcgctggaaatggttcctgaacggtctgaaaatcacatttgcggtcacgatcggtgcactgatcctcggtgttatcatcggtctgctgatcgctatagtccgcacggcgcatgattcccgccgcatgggcaaaagcaacatcattctgagtattctcaacgcaatctgcaagctgtatctgaccgtcatccgcggtacgcctatgatggttcagctgctgatcatgggctttgttatcatggtgcctaaggatgatacagcgcgtctggtgtgcggtattgttacactgggcatcaactcgggcgcatatgttgccgagatcgtgcgcggcggcctgatgtcggtcaatccgggtcagatggaggccggacgttcgctcggcctgaattatgcacagaccatgcgcatgatcgtcattccgcaggcgatcaagaacattcttccggcactcggcaatgagatgatcaccctgctgaaggatacctcgctcgtgtcggtcatcgcgctgcgcgacgtgaccaagcaggcacagaatattgtgtccaatacctatcaggcctatgtgccgtatgtcagccttgcgatcatctatctggtgctcgttatcatcctgaccaagctgctcggcatttttgagaggaggctgcgcgaaagtgatcgacgttaaaaacctgcacaaatcctttggcaaccatgaggtgctcaagggtgtcaacgagcatatcgagaagggcgagaaggtcgtagtcatcggcccgtccggctcgggcaagtccacctttctgcgctgcctgaacctgctcgaggagccgaccggcggcgaaattatcttcgagggacagaacatcaccgccaaggacacggatatcaatctggtgcgccgccgtatgggcatggtgttccagcagttcaacctgttcccgcacctgaccgtgcgcgagaatatcaagctggcaccggtcaagctcaaggtcatgaccgatgaagaggcggacaagcgtgcgctcgagctgcttgcgcgtgtcggtctgccggacaaggcggacagctatccggcacagctttccggcggtcagcagcagcgtatcgccatcgcgcgtgcgctggcaatgaatccggatgtgatgctgttcgacgagccgacctcggcgcttgacccggaaatggtcggtgaggtactcgaaatcatgaaggaactggccgacgacggcatgaccatggtcgttgttacccacgagatgggttttgcccgcgaggttgcaacgcgcgtgctgttcatggacggcggcaatatcgtagagcagaacgagccgaaggagttcttcgcaaatccgcagcatccgagactgaaggattttctgtcgaaggtcctctaagggggacgctgtcccccttagataccgggacagttcccgaggaaactgtcccggatatccccctctcgtccgcacggcggacgaggctcgggacacgcgtcccgaggcagtggtataaaagtcaggtacacgccctgacttttatggggaattttatgcggtctgctgcggcagacctgtccctgccagttccggcttcgccgaaaggcggcagggaatggtattccgtgcgctttgcgcgcggaacgtgaaaaggcacgctgtcaggcgtgcctttttggtatgctgcggtttatttggttgtttttttcggtgaacggacgactttcttcggggtgtttccgtagggcaggatgacccatcctgccgtttcggtgaacggacggcttttcttcggagcgtttccgtagggcgggctgcccacggcccgccgtataacgacgagaaacgggtaagcgggtacgctgctgcaatgcagtggtctgacaggggatttttgcggagaataacaaagggagaggacaaaacctctccctttttgtgcaattattgttcgccatatgcttgacggatctgttcaaagcatggtataatggtttgctgctgaaagttgcaggcttattcctatgcctgtcattatgttagcactgtctgctgaaaaatgcaagacgaatgaatgaagttttcgcaacgccgccgggcgtatcaaccaacaccaacagccgaaagaaacggagtgatcaaagcacatgaaggtgaaagacgtacagcacggcaaaaccacacgaaagagctttgcacgaatcgaagagattctcgaaatgccgaatctcatcgaggtgcagaagaagtcttacgaatggttcctggatcagggcctgcgtgaggtttttgacgataccgcgtccatcacggactacaccggaaatctggagctttccttcctcgatttttcgatggacgaggagccgaagtacagcattgaggagtgcaaggcacgagatgcaacgtatgcaactccgctgaaggtccgcatgcgtctgcgcaacaaggagaccggcgagatcaaggagcaggaaatcttcatgggtgatttcccgaagatgacccacgccgctaccttcatcatcaacggtgcagaacgcgcaatcgtatctcagctcgttcgttccccgggcgtatactacggcaaggagcttgacaagaccgacaaggttctgctctccgctaccgtaatcccgtaccgcggcgcatggctcgagtacgagaccgatgcaaacgacgttttctacgttcgcattgataaaaaccgcaagattccgatcaccagctttattcgtgccatcggcgttaagaccgatgccgagatcaaggagctgttcggtgaggatccgctgatcgttgcaaccctcgacaaggacccggcgcacaccgccgaggaagccctcatcgagatctacaagaagatgcgtccgggcgagccgccctctgtggagtcggctacctctctgatggatgccatgttcttcgatatgcgccgctacgacatttccgcagtcggccgctacaagtacaacaagaagctgaacatcgcacgccgcatcaccggccacaagctggtaaatgcagtcgctgacccgatgaccggcgaggttctggcagaggccggcgaggttctctcccgcgagaaggcaaccatgatggctgcccgcggcgtaaacagtgttgtgatcgagtctgccgagggcactgccgttaaggtattcggcaacggcatggtagacgtaaacgatttctccgagtacctcggcggcgcaaccgcagaggatctgggtctcaaggagaaggttcgcttcaccgtcctcaaggagatcatcgactccggcgtacagggcgacgagctgaagaagaccgtgaaggagcgtcacttcgatctggttccgaagaccatcatcgttgatgatatgctcgcttccatctgctatctgctcaacctcggtcacggcatcggcacggttgacgatatcgaccatctgggcaaccgccgtctgcgctgcgtaggcgagctgctgcagaaccagttccgcatcggcttctcccgcatggagcgcgttatccgcgagcgcatgaccattcaggacctcgacgttgttacgccgcagtccctgatcaatatccgcccggtaactgctgccatcaaggagttcttcggttcttctccgctgtcgcagttcatggatcagaacaacccgctggctgagctgacccacaagcgccgtatgtccgcccttggtcccggcggtctgtcccgtgaccgtgcatccttcgaggttcgagacgtacactactctcactacggccgtctgtgcccgatcgagacccctgaaggtccgaacatcggtctgatctcgtatctggcaacctacgcccgcatcaacgacttcggctttatcgaggcgccgtaccgcgttatcgaaaagatcaaggacgaggagaccggcgaggtccgctgccacgttaccgacgaggttcgctacatgaccgcggacgtcgaggacgagtacatcgtctgccaggctaccgagccgctcgacgagaacaacaacctcgtaaacgaccgtgtaacctgccgtaggcgcgacgagttcgtcgaggtagaccgcaaggacgttgacctgatggacgtttctccgcgcatgatgatctcggttgctaccgcattcatcccgttcctcgaccacgacgacgcaaaccgcgcactgatgggcgcgaacatgcagcgtcaggccgtaccgctgctccgcaccgaggctccgatcgttgcaaccggcatggagtacaaggcagctgttgactccggtacgattccgctggcagagggtgacggcgttgttacccgcgtaaccgcccgcgaggtttgcgtacactatgacaacggcaccgacaagacctatccgctgaccaagttcatgcgttccaaccagtccacctgtatcaacatgcgtccgatcgttgatctgggcgagcgtgtcaaggcaggcgacgttctgtccgacggcccgtctaccgatcagggcgaggttgcactgggcaagaatgccctcatcggcttcatgacctgggaaggctacaactacgaggacgccgtactgctgaacgagcgtctggtacgcgacgacgtttacacctccatccatatcgaggagtacgagtccgaatcccgtgataccaagctcggacccgaggagatcacccgtgatatcccgaacgtcggcgaggacgcactccgcaacctcgacgagcgcggcatcatccgcgttggcgctgaggttcgtgccggtgacattctggtcggcaaggttaccccgaagggcgagaccgagctgaccgcagaggagcgcctgctccgcgcgatcttcggcgagaaggcccgcgaggttcgtgatacctctctgcgtgcgccgcacggcgaatccggtatcgttgtagacgttaaggtatttacccgcgagaacggcgacgagctgtctcccggtgtcaacatggtcgtccgcgtttatatcgcgcagaagcgtaagatctctgtcggcgataagatggcaggccgtcatggcaacaagggtgtcgtttcccgcattctgccgcaggaggatatgccgttcctggaggatggccgtccgctcgacatcgtactgaacccgttgggcgtaccgtcccgaatgaacatcggtcaggtgctcgaggttcaccttggcttcgcagccaagaagctcggctggaaggtcgagaccccggtattcgacggcgcaacgctcgaggatatcaaggagacgctggttgcagcaggcgttaacgaggacggcaagagcgtcgtatacgacggccgtaccggtgagaagttcgataaccgcgtaaccgttggttatatgtactacctcaagctgcatcatctggtagacgataagatccatgcccgttcgaccggcccgtactcgctcgtaacccagcagcctctgggcggcaaggcgcagttcggcggccagcgcttcggcgagatggaagtttgggcgctggaagcatacggcgccgcatataccctgcaggagatcctgaccgtcaagtccgacgatatcaccggccgtgtcaagacctacgaggcgatcgtcaagggtcacaacgtaccgcagccgggcgttccggaatccttcaaggtactcaccaaggagctgcaggctctgtgtctggatattcaggttctggacgagaacatggaagtgatcgagctgtctgaggacgacgacgaggagaccgctgagtacagccgtccgatggagcaggctgtctccggcgcggatgacgagttcaccgcagcaggcttcggcatcaacgatgccgaggaaggcgacaccgatctctttgcactggataaccccgccgaggatggcggtgacgatgccgaaggtgatttcgacgacggtctgggcgaataaggctgagcgtaagtgaaatcatctgtgaatagggaaggagcatcttaaaatatatgggatatcatacgtttaacgccattaagatcggtctggcttcgcccgagctgatccgccagtggtcttacggcgaggtaaagaagcccgaaaccattaactaccgtacgctcaagccggaacgcgatggcctgttctgcgagcgtatctttggaccgaccaaggactgggagtgccactgcggcaagtacaagaaggtccgcttcaagggcaagatctgcgacaagtgcggcgttgaggtcaccaaggccaaggtccgccgcgagcgcatgggccacattgagctggcagcgccggtatcgcacatctggtacttcaagggcatcccgtcccgcatgggcctgatcctggatatcagcccgcgtgtactggagaaggtcctgtactttgcaaactatatcgtaattgatccgggcgacacgccgctgatgaagaagcagatcctgaccgaggctgagtaccgcgacatgcgtgaaaagtacgacgaggacttccgtgccggcatgggcgcggagtccatcaaggagctgctcgcggagctggatctcgaccagctctccaaggagctgaccgcagagctgcgtgaggcttccggccagaagcgcctgcgcatcatcaagcgactggaggttgttgaatccttccgtctgtcgcacaaccgcccggagtggatgatcatggacgttgttccggtcatcccgccggaaatccgcccgatggtacagctggacggcggccgcttcgcaacgagcgacctgaacgacctgtaccgccgcgtcatcaaccgcaacaaccgcctcaagcgcctgctcgagctgggtgcgccggacatcatcgtgcgcaacgagaagcgcatgctgcaggaggctgttgacgccctgatcgataacggccgccgcggccgcccggtcaccggcccgaacaaccgtgcactcaagagcctgtccgacatgctgaagggcaagcagggccgtttccgtcagaacctgctcggcaagcgagttgactactccggccgttcggttatcgtcgtaggcccggacctgaagatctatcagtgcggtctgccgaaggaaatggcactcgagctgttcaagccgttcgttatgaagaagctggttgaggacggcaccgcacagaacatcaagtctgccaagaagatggtagagcgcgcaaagcccgaggtatgggatgtgctcgagggcatcatcaagggtcatccggttatgctgaaccgtgcaccgactctgcaccgtctgggcattcaggcgttcgagccggtactcgtagaaggccgtgcgatccgcctgcatccgctggtatgtaccgcattcaacgccgacttcgacggcgaccagatggcagttcacgttccgctgtctgcagaggcacaggctgaggcccgtctgctgatgctgtccgcgaacaacctgctcaagccgcaggacggcaagccggttaccattccgtctcaggatatggtcctcggctcctactacctgaccatcgaccgcgataccgagccgggcgccggcaaggtattccgcaacgtggacgaggctctgatggcgtacaacgagggtatcgttggcattcacgcgccgatcaaggttcgtctgtccaaggaagtaaacggcaagaccgagtccgctatcgtagacgcgactccgggccgtctgatcttcaacgagcgcatcccgcaggacctcggctttgttgaccgctcggatccgtccaagaagtttgatcttgagatcatgttcacctgcggcaagaaggagcttggcaagatcattgacaagtgtatccgcgtacacggcttccacattaccgctgaggtgctcgactccatcaaggcgatgggctacaagtactccaccaagggtgcgctgaccgtagccgtagccgacatgctcgtgccggaaggcaaggacgagatgatccgcgagtctgagaagaaggttgccaagatcgaccgcaagtacaagcgcggctttatcaccgatcaggagcgctaccgtctgaccgtagccgagtgggaagagaccaccaagaaggttaccgcaaagctgcaggccaacatgaaggagcagcgctacaacccgattcacatgatggcggattccggtgcccgtggttctatcaaccagatccgtcagctggccggtatgcgaggcctgatggcatccgcctccggtaagaccatcgaaatcccgatcaagtccaacttccgtgaaggcctgaccgtactcgaatacttcatcgctgcccgcggtgctcgaaagggcatggccgataccgcactgcgtaccgctgactcgggttacctgacccgccgtctggtagacgtttctcaggacgttatcatccgtgaggacgactgcggcgcaaccaagggtatctgggtagaggatatcaaggaaggcaaccagatcatcgagccgctgcgcgagcgtctgctcggccgcttcccggttgacgatatcgtaaatccggagaccggcgaggttatcgtaccgaagagcaagatgatgaccgaggctgacgccgatgcggttgtcggcgcaggcatcacccgcgttcagatccgctccgtgctcgagtgccgtgcccgcaagggtgtctgcgcgcactgctacggcatcaacctggcaatgggcacgccggtcggcaagggcgaggctgtcggtatcatcgcagcacagtccatcggcgagccgggtacccagcttaccatgcgtaccttccataccggcggtgtcgcaggttcggatattacgcagggtcttccgcgagttgaggagctgttcgaggcccgcaagccgaagaaggctgcaacgcttgccgagatcggcggcgtggtctccatcgaggagtccaagcgcaccaccgtcaagaccgttaacatcgtcaacccgcagaccggcgatatgcgttcctaccagctggcttcgtcctccggtatccgcgtaaccgacggtcaggaggtcccgcagggcttccagctgaacgaaggctcgctcaacccgcatgacattctgcgtatcctcgatcctcgcgccgttcacgactacgagatcaaggaagttcagaaggtttaccgtcagcagggcgtagatatcaacgataagcatatcgaggttatcgttcgtcagatgatgcgcaaggttcgcgttgaggacgcgggcgacgctgaggttctgccgggttctgttatggactggctcgagttcgaggattacaacaacaaggtgcaggcacgcatcgacgccggcgaggaaggtctccgtctggctattgcggagccgaccctcatgggtatcaccaaggcatccctcgcaaccgattcctggatgtccgctgcatccttccaggagaccacccgcgtgctgaccgacgctgcgatcaagggcaaggtcgatccgctgatgggcctgaaggagaacgtaatcatcggcaagctgattccggccggctcgggtgtgtccgattactgcaccggtcactacgagcagactgtaaatctcgactgatttgcagaaagccgaaaacgctgtatagattaaacaaaacaggggaacactgtaaggtgttctcctgtttttgcttgtgccgaatggaaaattgagaatggagaattaccgtgacggtttacgatgtttctccgtttcaattttatgctgaatggataccgtagggtgcgacgaccacggcgcaccgtatctatccggtctgtacaatctacaccgtaggggcgaacattgttcgcccgcaaaccgataacgacaggcacatgtttattggtaaaccgtttgcataatgttaccccgtaggggaggccattggcctactgcgctatggttaaacggatgcgtgggcgagcactgctcgcccctacgggataacgtgtaccaatcgttagaaacggtgcgccgaggtcgtcgcaccctacggtatagcgtaatcattgaatgtatcccgcggaaactccttttgccaggtgtcaaatttgtctggaaaagaaatttctcgtaaaaaataaaaaaattcgagaaaacacttgacaacagggggacaaacccgtatactatgggagtatgccgtataggaggaatattatgctttcagaacttcacacggcgcacaaggtgatcggtgtaaagcagtcgaaaaaagcgattcgggacggcgcagccgcacaggtctttgttgcgctggacgcagaaaaacgagtcgtcggaccgatttatgagctttgcagtgaacacggtatggaagttaccgaggtcaccacaatgacggagctcggcgatgcggtcggcattgatgtcggcgcggcagtagtcgttgttctgcactgatttttctttgttgaatcgcgcaaaacgcgcttttcataaatatctttgaaagaaggaggaaataaaatgccaacttttaaccaactcgtccgtaagggtcgtgaggcagtcgttaccaagtctacggcaccggctcttcaggtaggctacaactctcagaagaagaaggctaccgatcagtccgctccgcagaagcgcggcgtttgcaccacggttaagaccatgaccccgaagaagccgaactctgctcttcgtaaggtagctcgtgtaaagctgaccaaccagatggaagtttccgcttacatccccggtgaaggccacaacctgcaggagcactctgtagttatggttcgcggcggtcgtgtaaaggaccttcctggtgttcgttaccacatcatccgtggtactctggatacccagggtgttgctaaccgtcgtcaggctcgttccaagtacggtgctaagcgcccgaaggcaggcaagtaatctgcgcctgaccgcgcatatcgtcgttgcacccacacttgcgtacctttgtacgcggcgtgcgggatgcgcctagatctgcacgatcatgcttgattactcctgtacagttacaatatgtgctgtgcagcctgtaatgagccaacccacaaggttttgcgagaaagttattttttcagcaaagcagctatgctttgtctgaggcattttagttccgattggataaatcgggcctttacctcggacaggcatgaacaacggcggtcaaagatccgccgaagtacctatgaaatcaaatatttttgaaggagggaagtaaagtgccaagaagaggtaatgtcccaaagagagacgttctgcccgatccgctttataattccaagctcgtcaccaagctggtaaactctatcatgctcgacggcaagaagggcgtttcgcagaaggttgtttatggtgctttcgatatcgttcgtgaaaagaccggtcgtgaaccgctggaggttttcaccgaggctatggaaaacatcatgccgaccctggaagttaaggctcgccgtgtaggcggcgctacctaccaggtgccgatggaagttcgcccggagcgtcgtcagaccctgggcctgcgttggatcaccaagtactcccgcgctcgttctgaaaagaccatgcgtgagcgtctggcaggcgagatcctggacgcttgcaacaatctgggcggtgctgttaagaagcgcgaggatacccacaagatggcagaggcgaacaaggcgttcgcacactaccgctactaatctgtcggtttccgcataacgctttgaaaggagagcaatatgcctagagaatattccctggaaagaaccagaaatatcggcatcatggcgcacatcgacgccggtaagaccactaccaccgagcgtattctgtattacaccggtgtaaaccataagatcggcgatacccacgacggtaccgctaccatggactggatggagcaggagcaggagcgtggtatcaccatcacctccgcagctaccacctgccactggtccggctctactcatcagttcccggagcatcgtatcaacatcatcgacaccccgggccacgttgactttaccgtagaggtagagcgctccctgcgtgtactggacggttccgtaaccgtattctgtgcaaagggcggcgttgagccgcagtctgagaccgtttggcatcaggctgacaagtacaaggttccgcgtatggcgttcgtaaacaagatggacatcatgggtgctgacttctacaacgtagtcggcatgatgaaggaccgtctgaagtgcaacgctgttccggttcagctgccgatcggctctgaggataccttcaagggtatcatcgacctgatcaccatgcgcgctgaggtttactatgacgacctcggcaaggatatccgcgacgaggatattccggctgacatgatggagaaggctcagcagtaccacgacgaactgtgggagcacgttgctgagctggacgaggacctcatgatgaagtacctcgagggcgaagagctgaccattccggaagttaaggctgcaatccgcaagggctgtatcgccaacgagatcgttccggtactctgcggcaccgcataccgcaacaagggcgtacagccgctgctggacgctgttatcgaatacatgccggctccgaccgacatcccggacatcaagggtgtaaacccgcagaccgacgaggaggattcccgtccgtcttctgatgatgcgccgttctctgcgctggcgttcaagatcgctaccgacccgttcgttggccgtctgacgttcttccgtgtttactccggcaccatcaccgctggttcctccgtactgaatgctaccaaggatcagcgcgagcgtctgggccgtattctgcagatgcacgctaaccatcgtcaggatatcgactgcgtatattccggcgatatcgctgcgggcatcggctttaagaacaccaccaccggcgatacgctgtgtgatgagaagcacccgatcatcctcgagtctatggagttcccggacccggttatccgtgttgcgatcgagccgaagaccaaggctggtcaggagaagatgggtatcgcgctggctaagctggcagaagaggacccgaccttcaagacctacaccgatgaagagaccggccagaccattatcgctggtatgggcgagcttcatctggagatcatcgttgaccgtctgctgcgcgagttcaaggtagaggctaacgtaggttctcctcaggttgcttacaaggagaccatccgccgctccgctgacgttgatcagaagtacgctcgtcagtccggtggtaagggccagtacggccatgttaagatcatcgttgagccgaacgagtccggcaagggctacgagttcatcaacaagatcgttggcggtgctatcccgaaggaatatatcgagcctgttaatcagggtatccagggcgctatgcagtctggtatcctcgcaggctacccggttgttgacgttaaggtaaccctgtatgatggctcttaccacgaagtcgactcctctgagatggcgttcaagatcgctggttctatggcgttcaaggaagctatgaagaaggctgatccggttctgatggagccgatcatgcaggttgacgtaatggtaccggaggagtatatgggcgacgttatcggcgacctgaactcccgtcgtggtcagatccagggcatggagccgcgcggcggcgtacaggctatctctgccggcgttccgctgagcgagatgttcggttacgcaactgctctgcgttcccgcacccagggccgtggccagtacaccatgcagccgagccactacactgaagtgccgaagagcattcaggagaagatcatcgacaaccgtaccaaaaacaacgactaaaatctgctgcagcctattgcattttttctcgaaatgcagtaaaataaatgcaacatgacttttaattcattttacgaggaggatatccacaatggcaaaggaaaaatttgaccgctctctgccgcacgttaacattggcaccatcggccacgttgaccacggcaagaccactctgaccgctgcaatcaccaaggttctggctctcgagggcgatgctgagtatcaggcatacgacgcaatcgacaaggctccggaggagaaggagcgcggcattaccatcaacaccgcacacgttgagtatcacaccgctaagcgtcactacgctcacgttgactgcccgggccatgccgactacgttaagaacatgatcaccggcgctgctcagatggacggtgctatcctggttgtatccgctgctgacggcccgatgccgcagacccgcgagcacatcctgctgtcccgtcaggtaggcgttccgtatatcgttgtcttcatgaacaaggctgatcaggtagacgacgaggagctgctcgacctggttgagatggagatccgtgagctgctgtcctcttacgatttcccgggcgacgacgttccggtaatccgtggttccgctctgaacgttctgacctgcgagtccaaggatccgaacgctccggagtacaagtgcatccacgagctgatggacgctgttgactcttatatcccgaccccggaccgcgctgctgacaagccgttcatcatgccggttgaggacgtattctccatcaccggtcgtggtaccgtagctaccggccgtgtagagcgtggccagctgaagatgggcgaggaagttgagatcgttggtctgatggacgctccgcgcaagaccgttgtaaccggtatcgagatgttccgcaagctgctggactacgctgaggctggcgacaacatcggcgctctgctccgcggcatccagaagaacgaggttgagcgtggccaggttctggctaagccgggctccattcacccgcacaccaagttccacggtcaggtatacgttctgaagaaggaagagggcggccgtcatactccgttcttcaacaactaccgtccgcagttctacttccgtaccaccgacgtaactggcgttatcactctgccggaaggcactgagatgtgcatgccgggcgataacgttgagatggacgttgagctgatcaccccgatcgctatcgaggaaggcctgcgtttcgctatccgtgagggtggccgcaccgtaggttccggcgtcgtaaccgctatcaacgcttaatttcagttaagcaatagcataacgcaatttacaagctcccatgcttcggcatgggagcttttttgtgcgtaaaatcctctttcctgcgcatactatgcgaaggagggatgcaattatgtcggaaaatcatgaaaaccgctatcagctccgggccgccgcgaaggcgttcgagtggctgcgccgcagcaaaccggcagtggccgcgcgggaacaggaaaagatgagcgagggtatctcgctgccgcccaatgaacgggattgcggaaccgcctgttccatgcagggcacagatcgggaaacactgaatgagtggtgcaaagaacacgaaacctgaaaaagagacgcgaaagcgtctctttttcagaaatggagaattgagaatggaaaatgaaatttggttatcgttctatcatcacgttcattctccattctcaattttcaattatccccggattttctgctcggtttacttatccgaacaattgtgctatactatatactaacaaagtgttccctccgtgcataggctgatagcaggagggaacgctcatgtctgtttttctgcaatcggttctggcggtatttgccgcggtgggattttacaccgtgctgcacacggtgtacgagatcgtctccgcacggctgctgaggctgcacggctcggcggagctgacgctgtacggcgacggctgcgatgccgtcagtgaacacctgatccgcgcggcactgcgcgtgcggcggcagtattttcccggtctgctgatcacatttgtcgaaatcggcagcgggcagggacagaatatcgccaagtacatggcggcacggcaggacataacctatctggaatgacaagttgggacggtgggacgttggacgaaagagaatatttgatcgtgcgcggcacggtgcagcagatcgtttactacaacgacgaaaacggctatgccgtgctgcgccttgctgcggaaaacggagccgaggtcacggcgaccggcacgtttcccaacattggactgggtgaggaggtcattctgaccggctgctgggtgacgcacccgacctacggcgagcagtttgcgaccgaggcgtttgagcgccggctgccgacctcggtgcgcggcatcgcagagtacctcggttcgggcctgattcgcggaattggtccgcggctggcggcaaaaattgcggaaaagttcggtgaggacacgtttgacattcttatgcacgagccggagcgtctgtcggagctgcgcggcattaccgaccgcaaggcgaaggagatcggccgtcagttcaccgaacagagcgaaatgcgcctgctgatggacttcctgagcgaacacggtctgccggtcgcgctcacgccgctgctgtacaagcgcctgcacgacagcgccatcgacgcgctgtgcgagaacccgtatctgctgtgtgacccatactatgatgtggatttcaagctggcggacggtctggcgatggagcttggactgtcgctgctgagcgatgagcgcgtggacgcgggcattctgtatacactgaccttcaacctgaacaacggccacacgtttatcccggtggagaagctgctgtacgcggtgtgcatgctgctgagcgacgatgatgtggtcgtggatgaggaccgggcgctgcgcggcattgcccgtctggaggagaaggggcggctggtgcgtgagcacatcgcaggccgcgacgcggtctatctgcgcgatatgcacgacgcggaggcctaccttgccgaaatgctcggctacatggcagagcgtaattatgagtacgattttgatgtggatgagctgctttccgcgcttttggagagcagtgagttcactttttccgagaaacagcagcttgcgatttcaacggctgcacgcaatggtctggttatcctgaccggcggcccgggcaccggcaaaacgaccacggtgcgcggaatcctgcaggtgtttgaggcactgggactggacacgctgctcgccgcgccgaccggccgcgcggcaaaacgtctttccgacctgactggcatggaggcgaaaaccattcaccggctgctcgaggcaggctttgcgggcggcggacgcacggtgtttgcccgcagtgtgaccaatccgctcgagtgcgacgcggtcattctggacgaggtgtccatggtggacatcacgctcatgcaggcgctcatcaatgcgctgccgcacggtgcgcggctcgtgctcgtcggtgatgccgatcagctgccgccggtcggtccgggcaacttcctgcgcgacctgatcacctcacatcgggtgccgaccattcagctgaccgagattttccgtcaggcgcagcagtcggatattgtcatgaacgcgcacgcggtcaacgcgggtgaaatgcccagaccatccggtgcggacggcgactttttcatcatgaaacgggcggagccgacgtctgttatcgaaacggtggcacagctttgcgctcagagactgcccaagcactacggcttcactcctgcacagatacaggtgctttcgcctgccaagcggcacggcagcggaaccattccgctcaaccgccgtctgcaggaggcactcaatccaccaagtgaaagcaagctggaaaagcgcttcggagacaccattttccgcgagggcgaccgcgtgatgcaggtgcgaaacaactacgacatcgtgtgggaaaagcagggggacgacgagcagggaaccggcgtgttcaacggcgacgtcggcgagatcatccgcatttttccgcagcaggagtgcatggtgattcgctttgacgaccgcattgcgacttacaccttcgatatgctgaacgagctggagctggcgtatgccgttaccgtacataaatcgcagggcagcgagtttgatgcggtggtgctcgctctgtcggacggtctgccgcgcaagctgctcacgcgcaacattctctacaccgcgatcacacgcgcgaagcgtctgctcgttatcgtcggcagccaggatgtggtagcgtatatggtaaataacaaccagaagggcagacggtacagcgcgctgaaagcccgtcttaggttagccgaaactcagtaaaaggtgctgataaaatgcagaagaaagagaaaaatactcgcaagggatttacgctggtggaattgatcgttgtgctggtcattctggcgatccttgcggcatttatgataccggcgctgatacagtatatcgagagaagtctggaggcatccgacattctggatgtccgtatggcctatattgatgtcatgacggcggtaacggaaggggataccgccaatatggacaaaacggtcaagctgaagcagaagcaggatgactggcagtcgagagatcccattacaattgcaggcattactcattgtaagacggatggaaataccgaaaactggaaaggaatccctaccgcgggcggggaatgcaaggtgtactacgacagcgcagcggctgtgatcgtgtttgactggaagggcaagagcacagcggacagcacgatcaactggaacgagaatctgcacgacatactcgagaagaccgacattttaccgaacctgaagaataatcagaattttgagatcgactcgaagtgccccaattccagtatggtgcccaaggtgaaggaacagatcggaagcgacagcctgctgaacaatggcacatgggcgtttctcggcagttccacgaacaagagcaaccgctatttgttctggacatcggtcgatacaaaggccgtcggtccgacaaagcagataccggtcattgtcagcccggcgagcggcggctattacatctccgaaacgattaccgcgacccgagttaacaacggccaaaaatatgttgcgattgcggaccatatcaacagttacagcacctttaaggagtataccaaagacaagacgaaatatgaaacgctggcggaggcttatgcagcctataaaaaacaggtgaacggcaacgcaaaatacacggagtataagaacacactgccggagtgatgccattttctctgtcgaattttgggtatttgccccggagtcttgcaaatggcgcacaaaatctgtataatggtaatactgtcaatccacgcgaacagagcgcggagaaaggaatgaaatatggcttcttttctgcaaagaatcgcgaaaaagatgtcgcttttttcgagcgatatcggcatcgacctcggcacggcaaccgtgctggtctatgtcaagggcaagggcgttgtacttaacgagccgtccgttgtggcggtggacaaggtttccggcaaaatccttgccgtgggcgaggaagcgcagagcatgcttggccgtacaccgggcaacattgtcgccatccgtccgctgcgcgagggcgttatttcggattacgagatgaccgagcgcatgatcaaggaattcatcgcaaaggtgcagggtatccacctgttcaagccgaatgtggtcatttgcgtgccgtccatcatcactgaggtggaggagcgtgccgttattgatgcgggcacgcaggcgggcgcaaagcgcgtttttctggtcgaggagccggtcgcggcggccatcggcgcgggcatcaacatcaacagggccaacggcaatctggtggtcgatattggcggcggcacgaccgacgtggcggttatttcgcttggcggcattgtcgagtccacgtccatcaaggtcgcgggcgataagttcgacgaggccattgtcaagtacgtccgccgtaagcacaatgcactgatcggcgaccgcacggcagaggagatcaagcgcacagtcggctgtgtgtatccgcgcagcgaggaagcaatcatggaggtcaggggacgctgtctgatgaccggtctgccgcgcacgtttaccgtaagctcgagtgagattctcgatgcgctcgaggaggtctcctcggcgatcgtcgaggcggtgcactgggtgctcgagcgcacacctcccgagctgaccggcgacatttccgccaacggcatcaccatgacaggcggcggttcgctgatctggggcttcgataagctgatcgcctccaagaccggcattccgacgcgcgtcgcggacgaagcggtttcgtgcgtggcatacggtaccggcaactgtctggaaaacctgtcgaaaatgcaggacggcacgatgaatctgtcgcggcaaagacaaatgaaagcgcgctgaccgctatataggggggattgggtaccccttatatacggcagacagttccggtaggaaaatctgtcatgcggatgcaatttgcaggcaaattgaaatttttaaggcaataccgcataattgaacaagagtgatttgcgagtaaattttgcgtactgacgaggcacagttttgcggtaatacttgatgtattaccgtgaaactgcaacaaagtcagagcacaaaatttccgcaaagcaccgccgctttaattgtgcggtgttgccttaagattggctttattgtggggcaggtgaatcttgatgagtaaaaacgtagttgcaaccattcgagaggacgcaccgttcgtaccggcgggacgctattacttattttccgagccggcggcgtggacgctgatgccgaccgacgagggcagcgggcagctgccgctcacgctggacaagggcacatacacgcttaccgcggacgcagcaccgaccgagccggacgaaatgcagggtatgcttcgtgtgtacaagctgcgccctgttgcgctgaccctgatcgacagcagcggaaaccatgccgcgctttccgtgtcctacggcgcggacagtcttgcggtgctgcaaagctggggattcgactgccgcagtgccggtgagccgatggacaagcctgcggaaaccttcacggttgccgttaaaaacggcggcggactgctgccgaagggcaagctggaggtctggcgcgacggcgatgcgctgcgctttttccgtcgggataagggtctctacacgggcaagggcagcctgcagagcggtgagctgccggttcgttcgattcgctccgtaaaggcagcgggagaactgcgtcgggaggcgtatcaggtacacggcacagagggcggtcttatgaccggcagagcgatcgcgatcggttcggcgctggcacttgtctttggcttgttcggtacacttctgctgaatattgtcggtctggtaatcggcatcgtgatcggcataatcgtcggcattcagaccagtttgcaggagggtgaaccggaccgtacggaataccgcgaggtagacgagcgcagcacagcggtagagattgacgcaccgacaggcggtgctgcaaccttgttctttgaaccgcaggcaatggagagcttcgctaaattgctgacgttcgaggaaatgcgcggagaagcaaggaaaactgcaccaaaggcggatatgatcgaccagttggagcggctggctggactgcacgaaaaagggcacctgacagatgaagaatttgagcaggcgaaagcgcgtctgctcgggaaaatctgaggaatttatgaccgaacaggaaaaatacatgaaggccgcgctcaaactggcgcaaaaggcggcggacgagggcgaagtgccggtcggcgcggtggttgtctgcgacggcaaaattgtcggacgcggacgcaaccgccgggaaacaaagaaaaacgcactgcaccatgcagaaatcgaggccatcgagaaggcgtgcaaaaagctgggcggctggcggctgcaccgttgcgatctgtacgttacgctcgagccgtgcccgatgtgcgcaggcgcgctcatcaactcgcgcatgaaaaccgtgtactacggtgcacccgacccgaaggccggctcgtgcggctcgctgataaacctgttcgcactgccgtacaatcatcagcccgcgctggtgagcggcgtgctggagcaggaatgcgcggacattctgcggaatttcttccgcgagctgcgcaaaaagcggaaagagatccgcaaattagagaaatcacgcgtcgaagaacaatcatgacgcttgattatagtatgtaagtcgtgccgatattgcagtttgcttaatacgcggcacagaaaaaaggggaaaaataaacaatgccaagagaaagactcggttcacgtctcggcttcatcctgctttctgcaggctgtgccatcggcgtgggcaacgtatggaagtttccgtggatggtcggtcagtacggcggcggcgcgttcgtcgtgtgctatgtgctgttcctgctcatcctcggtctgccgatcatgacaatggaatttgccatcggccgtgtgagccagaaaagtccggtgcgggcgtatcaggcgctcgagaagccgggcagcaagtggcacatccacggctatctggcgatgatcggcaactacctgctgatgatgttctacaccaccgtgtgcggctggatgctgtactacttctacctgacggtcagcggccgatttgtcggtgcgaccagtgagcaggtgcaggcagcctttccggaaatgctcggcaagccggtggttatgacggtctgcatggttgcggtcgttatcgtcggctttatgatcaactcgttcggtctgcagggcggtctggagcgcgttaccaaggtgatgatgatcattctgctggccatcatggttattctggcgatcaacagcatcgtgaccgaaggctcgggcgagggtctgcgcttctatctgattccggatctcggccgtatgcaggagtgcggcatcgccaatgttatcgttgccgcgatgaatcaggcgttcttcacgctgtcgctcggcatcggcgcgatggctatcttcggcagctatatcggcaagggccgtgcgctgctcggcgaggccgtcaatgttgcgattctggatacgttcgtagcatttactgccggtctgatcatcttcccggcgtgctttgccttcggcgtggcaccggacagcggtccgaacctgatcttcgtcacgctgccgaatatctttaaccacatggcgctcggccgcctgtggggcagcctgttcttcgtattcatggcgtttgcggctttctcgaccgtcctcgctgtgttcgagaacatcatgtcctgctgcatggacctgaccggctggagccgcaaaaagaccgcagccatcaacatcgtgctgatgatcctgctgtcgctgccgtgcgtgctcggtttcaatgtctggtccggcttccagccgttcggcgcaggctcgaacgtgctcgacctcgaggacttcctcgtgtccaacatctggctgccgctcggctcgctggtttacctgctgttctgcacctcccgctgcggctggggttggaagaacttcaaggaggaggccaacgaaggcggcggactcaaggtcaaggataatatccgcttctatgtaagctatatcctgccgattatcgtgctcatcatctttgcactcggcattaaggataagttcttctaaagaaatgcgaaaagcaccgcgaaagcggtgcttttttcgtatgtgaagcagtaatggagaattgaaaatggagattgaccctgcggtgaagcaatgtgcagatgggttgcacggcggggcaccccagtgtggcttctcctgcccttagggcaattcaccttgtgttgcgcctgcgaagagtagccgatatgtgtagcagtagattatctgtgaactgcgaataggcggagaaagacacgcaagagtaacccgactgccgtttcccttttcgaagcggtcgccggtctctggtatgcgtcagattaggaaacaagggaaaggtaggagttcaaagaggaagggcactcatttaatccgcgcacggcgcgggaatgatgtttagcagcctacgggcaaaccgcaggtgtcccttcctttttgcccaccgccgcgggtgcggcgaacctcccagccaaaggctggctccaattccgcatccgatagcacgcatataaaccccaatcccgcataagctgttgcaagaagcaaaaagggaggcacccgccatgcaggaggaaaaaagcgcagtctataccgtaatcttaggcgtatgcctgttcctgtgcctgctgatgctgggaaatatgctgatgggcagggcggataccggcacggcgcctgccgcacccgaggagggcgatgcaatggaatttcacatcacggaggacgatatcgcgtctgtgctgaccgaagcgctgccgtttccggtcgaggacacggcggtcaaaatcagccgtgacggcacgatcgccgtgacggcagccgtaacccgtcaagcactgacggaaagcaatctggtacccggcaagctgcgcacggctctgctgtttctgccggagcgctgcaagctgtacggcgcgtggagcgcagctgtttcaaacggcaaactcagccttgcctgccggaccatcaagctggaaggcttcaccttgcccgagcagaccgctcaggcactctccgatgcgttcgccgcacagtggaatacccacatggaacagcgggacttcacgccgcagaccatacagtggcaggacggggaagcggtgctgctgggataaccgctctcaacaggcaaaagaaaaatcccttcggaaaaccgaagggatttctggtatgtaaccttactcaaaaattacgcggcctgcgccctgatagcgggtcgcatagctgccggtcagcgacgagtacttaaccacatcgcccgtgctgggtgcgtggatgaactggttactgccgacataaatgcctacatggctgatggacgaggtactgctgccgaagaataccagatcgcccggcagaaggtcgtcgcgggaaacacgggtggtggcatcatactgtgcctgagcgacacgcgggatggagccgaccgtgttcttgaacacataggaggtgaagccggagcagtcaaagccgctcggcgtgctgccgccgtatacatacggaacaccgaggaactgtgcagcatagttcagcacgctctggcgctttgcgctgatcgagacagaagctgcggtgttcgacgggctgattgccgtaccggacgaagcagttacgaggtagtccgcactgatgtagccggccttgcctgcgtaggataccttgctccagccgttagacatgctgagcacggtaacagcggtgccgttcttcagctcaccgagaatggtggaagaggtacttgccgcagagcggaagtttacggtagaggagcacttaactactgctgccgtaccggtggacgcggacgtgttattggatgccgaaccggtggtcgatacataatcctgcttgatgtagccggtcttgccggagcaggttaccttgcaccagccgttcgcggtgctgacaacggtaactgcggtgccgttcttcagctctgccagaatggaagaggaagtattggcctcggaacgcaggtttacactcgaggaacacttcaccgtaccggcggtgccggtcgtagaggtaacggtgttcgacggagcgatggcggtgccggcggagctgcttgcgagcgtgatataatccggatggatatagccggtcttgccattgtatgtaaccttgtaccagccgctgcttacgccgactacatttaccttggtgccgttcttcagctcaccgtaagaggtggacgaggtgttcggcgccgaacggaaatttacactgctcgagcactttacagtgccggtgccgagtgcaacgttggttgcggtggtgccggtcaggtactcgccgctgacgtagccttccttgccgtttacggataccttgtaccagctggagctgttattcagtaccgcaaccgtggtacccttggagagggtcgtgatcactgcaccgccgggggactgacgcaggtaaagcgaatctgcgtttaccttggcctgaaatactgccagcgagttcggcaggaccatcgacatcgcaagtgcaccggaaagtgcgaagcgagcgagttttttagaaaaagacatgaaattgaagcctccgtttcaaaatgggagaaaacagcctttacactgccgcagaaagctgcggtgaagtcttacttcgtgtgcagtgctctgccgagccagatggatgcaatatccatcgctgcccacatgctgttcttctcggttttcttgacgatacgctctttcatacgtacgttgggatcggtctgctgaagctgtacggatacacgctttgcaaccggcagacccttgtaatcactagattcgaggatctgcatcataatgatgtgagagtcactcatcgagccgtaatagatgatattttccttacgcatcagcgggtgacccttgtattccagaaggttattcttcttggtggtaggcattatctgcactccttatagttacaaaatggttacattccaaagttacattacggttacagtatagcatgctcgaaccggtttgtcaaacattgttttgaaatttcgcatttttgtgataaaatagagcctgtcaaatgcgaaaaaaacgcaggaatcgacagcgaaaatccacagcggccgcacgcgcacgagagtaaggttacagacgctgtaacccgattaaacaccataggcaacaccgcacaattaaagctgcggcgctttgcggtaattttgtgtcctaacttcgttgtaatttcacggtaatacatcaagtattaccgcaaaactacgcctcgttagtacgcaaaattcctcgcaaatcgctcttgttcaattatgcggtgttacctattatatataggcgttcacagagcgcgtgtcgggccgctgagagcaaaggaatgtacatttgtgaaatttgcttttttcaccttgggctgcaaggttaatttatttgagacgcaggcgctcagtcagctggcgcaggcgcgcggacatgagatcgtggataaggacgcggacgccgtgatcgtcaacacctgtacggtaacatcggtgtccgaccataagaatatccgcgcgttccacaagctgcggagaaacaatccgaacgcggttatcgcggcgtgcggctgctttgcacagaccgatccggagcgtgtccgcgccaccggcgagatcgacctcatctgcggtaccagggacagggcgcaggtgatcggcctgtgcgagcaggccgtcagcggacaggctgtgcaggtgcatgcgagcgaggacagcggctttgaggccctgcccgccggtatcccgcatggccgcacgcgcgcgctgcttaaagttgaggacggctgcaacaacttctgcacctactgcatcattccgtatgcaagaggacgggtgcgctctctgccggtcgagcaggcgcttgagcagacggcacggctggctgacgcaggcgtgcacgagatcgtgctgaccggtatcgagatcgcgtcctacggcaaggactttaagccgcaggtgccgctcaccgagctgctggagaagctgctgaccgcgcagccgaacgtgcagttccggcttggctctctcgacccgcgggcggtggacgacgcgttctgtgaacggctttccggctttgacaatctcgcacggcatttccatttgtccatgcagagcggctgcgataccgttctccggcgcatgaaccgccactacacgagcgaggaattttaccggtgtgtcgagcggctgagacgtgctttcccggactgctcggtcacgaccgatttgattgtcggctttccgggcgagaccgaggacgagtttacgcagacgctggtctttctggagagatgcgcgttcgcgtccgtccatgtgttcccgtattctgtgcgcgagggcacaaaggcggccgccatgccgggtcagctcgatcagcagaccaaaaccgcccgcgccgagcgggcaaagcaggtggcggagacactcagcgctgcctatcgaaagcagtttgtcggccgcacgctgtacgcgctgcccgagcacccgaccggcggcctgtgggcggcgcacggacgctacggctttcctgtatatatagaggataaggcggagaaaaatcatccggtcaccgtaaaggttatcggtctgcacaaggacggcgtattggcgaaaattgagaattgagaatgtgtaaccattttcggcctcttaccatagaatgtaatgaaatctttgataggaggaaatgacagtatgtgttcttctaacagcttctggggcgaaaattcctggtggtggattatcatcctgatcatcctgatctgggtatgctgcggtcagggcagcggcggctgtggttcctgcggtacctgtggtgataatacctgcggcggctgcggtaattgcggcaactgctgctgctgagcggccaacatatccgcagaagggagaggcaccgcgtgagcggtgcctttttcgttttcgtggtataagggcaaccgagggaatgcgaactgcgcaggcgtttttttcggcaccggctgaccgggggacgcgaactgcgtaagcgtgttcgcccctaacgggcgggaggtattcgcttgaaatcaagcggagagttgcgctctgcggagcgcggggattcgccgcgcccagcggcagggagtgcgctgacgccgcgcgggcgcacaagagggtagacacctgcggtttccaccctcttgtggatcacccctttcccttggatggtctggcgcagattgccgacatgtgaccgctgcgaaataaggggaacggcagaggatttttttcttccgtgtctttcgcaacctgttcgcagggtcagataacgttctgctacacaggcggtttactctgcgcagagcgcggcatagcagtgccgcgcaactctttaacgcactataccgcgtggcacctgcgaattaggcgattgatacaatttatcttcgcaggtgctgtctatcacaacgcgctcacgaattgcgcggcactgctatgccgcgcccagcggaggttttctgatctgtgtagcagtaatgtatctgacactgcgaacaggttgagaaagatacggtagaaaaaatcctctgccgtaccccatttcggagcggtcacatgtaggtaatctgcgccgggctaacaaacaagggaaaggtaggagttcaaagaggaagggaaaccgcaggtgtcccttcctttttgccccccgcggcgggcgccgcaacgctcccgccgtccacagacggcgaatctcccgctgaggttcagcgaaaaactctccgtccgttagggacgaacccgcctacggcagttcgtgtgccccggtcagccggtgcaggaaaaggagccgcccgtcaggggcgaacccgctgacgcagttcgagcaccccgctcagcaggtgcagaaaaggagccgcccgttaggggcgaacccgctgacgcagttcgcgcaccccggtcagccggtgcagaaaaggagccgcaccgtcaggtcgaacccgcctgcggcagttcgtgtgccccggtcaaccggtgcaggaaagcgccgggttcaacccgcgataaaaattttcaagaaaatatgcgttaccctcttgcaaaatacgcgaaaatagggtattatatacaagcactgttttgtatgaacagtcgaatgatgcttaatgatgtaaaaaatactattatttggaggcatagcgattatgaccgcaggtgaatttcgtaacggcgtaacttttgaaatggacggtcaggtacagcaggttattgagttccagcatgtaaagccgggcaagggcgctgcttttgttcgtgtcaagatgaagaacgtcgtaaccggtgcggttactgagacctccttcaacccgactgctaagttcgaggaggctttcgtagagcgccgcgagatgcagtatctgtacaatgaaggtgacctgtactacttcatggacaacgagacctacgagcagatcccgatcagcaaggatactctgggcgacgacttccgcttcgtgaaggagaacgagaacgttaaggttctttcctacaagggcagcgttttcgcagttgagccgccgctgttcgttgagctcgagatcactgagaccgagccgggcgttaagggcaacacggctactaacgtactcaagcccgctaccgttgagaccggtgctgttgttaaggttccgatctttatcgagcagggtgagcgcatccagatcgacacccgtaccggtgagtatctgggccgcagcaagaccaagtaaaaatttgcagccaacagggatggcagccgccatccctgatttggacatttagctcagctggaagagcatccgcttgacgtgcggaaggtcagcggttcgaacccgttaatgtccaccatcaagccactcattttgagtggctttttcttttgtctgcacaaaagcagctgagaccccacatctcagctgcttctattttcgtcccacattttgcttttactctctgtgctgccgctatccttcggcagctgccttttattgctcggtctcgcggatatatttgaaaaccgagtgctccagataaaattgcacgtcaccttctgtcagctcatacggcttgtggccgtcaatgcacagccagtatcgtccgtccgcactttgcttgagataggcattctcgtcgttaaaatagacggtcgagctgctgtcaggctcggccggcggctcgaatgccggctgcggcagcaccgcatacgacagtaccagcaggacggcaaagctgccgatgagtacggcgcttgcggttcggtcgttcggctgctctgcgcaggcgagcacggcggtgaatcgctcccgcatggccttgtccgcctcggcgcgaaacagggccgtggacggctgcggcaccggctgctgtgtgcagccttgcttcatcgcggagaggatggcgcgcagataggctgtgcgttcctgcgcattcagcgtctgtgcaatcgcacggtcacacttaagctcgagcgtctgttccaaatccttctgcagcaggtatacgaccggattccaccagaaaatgatgcagtacagcgttacgagcagcttgacagccgtatcatggttgagaaaatgcgtgtactcgtgcagcagaatgtaatgcagctcggcatctgtgtacgtcttgtccggcagaatgatatatcggcgcagcacacctacgccaaaggcggattcgatattcgcggctgtacgtccgcgaactttgatggtgcggccggtctgacgccggatctcgctcagcagggaagccgtgcggctgtcccatggcctggcttgccgcgcagcgcggatggctttgcgatactgcagcgcgtaacgaatcaacagaaaaactgtgccgaacagccagattgcacacaaaagcagtccgaccggcaggtgcgtgattggctcgggcttgcgcgtcagaaagctgtagatgcgcggatacacgacgctgtcgctcacaatcactgtgtgcggaaactcgagcggcagcagcaggcgcgcggcgcagaacaggtacagcagcaccatggtcagcacgccgaaatgcggccggaagcgtgtgcgccgcacaagatagattacaataatcaacaaactgctccaaaaaagtgcagatataaaggaaaacagggttatttgcatattatttctcttctttgttctgcagcgcagcttcgtactgatcgaccattttttccagctcggcaatcagcttttcttcctgctcggattcgtttgatttggcaggttttttgaacagcgccacggcgattcgggcaaacagtgcctggttcacgccttgctcctcgagcatgttcgccagaaattcgtccttggtgtagcaggggacgaactgccgcgactgatagcgtccgttctgcagcagaccgctgacctgcaccatgccttttttgacaagctgaccgagcagtttgtcgatataattggtgttccagcgggcttccgtaactttttcggcaagctgcagcgttgtgagcggacggttttcccgccataaggtgtccattagaatttcctcggagttggacagcttgaagcgcttcattggcttcgcctccgttttgataatcacctgtaaggtgtttattataagataagaataaccacctttaaggtggttgtcaatatcttgatggaaatttgtaggaatatctaaaacgggacatgacaaattgtgagaagtgacaacatattttctggtgacagggggagaggcacacctttcggtgtgcctcatttcattttccacagatattctttttgcaggcgctgacggggtaccatgcacatccgcgacaaatatcctccagcatggccggggtcatttgtgtgtcgatagcacggatcaggtcctgataaacatactcgccctcgtgcagatcaaagtattcgaccgtctttcggtcaaagcggaagaccttttcctgtgattcgcacaggtcgtcagcggtgtggtgcgggcagtgcgcgcacagagaatccgaaccaaagacaagccggattcgggttcccggtacatttcgcagagaatgcacaatcgcactcatattttgcacaaattctgtgctatagcccttgccggagtagccttgtgtgcaaagcagatgatgcgggcgcaaccggatcatgccttgagccccgggatgcgcttgcgaacgagaaagccgatcacagttgcaagaacagccttgatgacagcggtcgggatgaacggcagcacgcatgcggtcacgcctgcggcgatcgagctgttcatgagtacgcagaacatcgccgtgccgacaacgtagttggcaattgtgccgatgatcagtgcgagtacatatgcgccgcggaatgcatgacggtggtcggcgccccagccgatgataaacgccatcagcgggaaggagatcaaaaaaccgccggtaggaccgataaacttgtcaaaaccgccggaaaagttcgcaagcaccggtacgccgacggcaccgagcagcagataaattacgcttgaaaccgtgctcagcttggcgccgagaacgacagccgccagtgtaattgcgaacgtctgcatggtcatgggtacgccgccgggcatcggaatggaaatctgcgccatgatcgcgatgaccgccgcgaacagtccggaatagcagatctcgcgcacggaaaaacggctgcgcggcgcagttttgctggaaatatcactcattgggagttcctcctcgttgttttgcttattgcattaaaccacagatttactgcaatgtcaactggttttgcaaaaatggtttacgatatgcgcaaaaaagaaacagctgttccgtgcatttgcacagaacagctgtttgctcagctcgcagagcgctcccagcgggcaaaaatgcgttggagaatcaggcagaacagcagcgcaaagaccacgccgaacacattctgcgcgacacgcagaccgaccgcgcttttgagtccgtatgcgctggttgcaatagcgagcgcaccgaacgtgttgaacacagcctgccagccgtatttcgcggaaaaaccgacaccgatgccgccaatcacgccgatataggcgtaaatcgaggacggaagcaggaaatacagcgctaaaaagcagcaaacacctgcgatatttccaatgatgcgccagcgaacgcggtagcgcatatcgtccatcgcgggaagaattgcgctcatggcggcaatgcccgcccacatcgcacgcggcatgccgctcagctctgcaaggaaaagcacgagcggaacgcagatgatctggcaaagctgccatttggagcgcggatggcgcagatcgaaagcaggaaggatgtctcctgcacagagctcataggcattgccgcgatggttgccgtagaataccgcgcagaccagaagcgcaccgacagcaagtccaaacaggcgcatttgataggcgtgcccgctcacatcgtaaccatacagcagcagatagccgagcacgagtgtggactgattgaacattctcggctcgtggcagccgaacagaatgagcagggcaatcgcagcagcattgatgaacaatccgccaaccgggccggccagattggctgcatgcggtccgacggccataatgccgaaaaatccggcgagcagcagcgtggactgccctgtgcgaatgcacagatgtgcgctgcggaatacgagcagatacagcagcacgactacgccgacaatgctgttgtccgcgccgaagcccagactgtaaagtgaaacgaaaataaagcagaatgcgacggttatcgcaattttggtcaaatatacggcaatatggtacagtttttcacgctgtgacgcactctcgcggatgattttctttgagcctgcctgattgacctgtaattcctgataaaatgtcatgaaattcctttccaatcggtgaaaatgagtaactatataactgtatcaccatcgagaaggaatttcaactgttttttttaaaatcgaacaacaggccggatatacttccagaaacgtacacaatcatgcacaaaatagaacacacgaccgggtgcggtatccagacagcagccggcggcctcgtaatcgaaatcgcgcatcgcacgctcgatttttgcctcaacaagactgttttccgtctgcagatcaaacggaccgtgctcgaaaaccagataatccccttcggggacgtccatcagctgcagcggagcgggcaccgcgtcggtgcaatcgcgcggcagacgcacaccccagcattccgccagaggaatgccccagctgcagatacggccgctcggctcgttcacgaacgccatctgctgttcggcttcgggggcaagctgccgcagaagagcgctgaccgtttctaaatccgctccgggaatgcgggactgcttttgcataaaatcccagtaaccgatgctctcatagttgcgaatgtgtgcaaatttgtgcgccggaagcgtgataaaatacgtctgtatatcgttttccgtgcctgcgggagcctgctctgcgagataacagtccagcggccgaatcaccgtgcgcagcgacagcgggcggggagagcgccgatattcgccgggcgtgatgccgtaagccgcacggaacgcgcgcgtgaacgcctcctgcgaggaaaaaccgcagtcgagcgcgatatcaagcagccgctgttctccgtcccgaaccgcgagcagcgcgagcgccggacggcgcgcctgcacaaaatcccgcagggaagtgcccgtcagcgcgtgaaattggtgcgaaacctgcgactgcgaacagtcaagcagcctcgctaaatgcgcgagtgtcagcgtttcgccctcgcgcacacggatacagcggtcaatctcagtgatcagccgcagaacattgtcgtgccagttttgcatgaaaatccctccttgtccctgcattatacaggaaaatgagctgtgccgcttgatctgacctgcaaaaaaagaaaaaccgacgtaaaaacgccggttttcgatcttatccgttcttcttgatggcattgatgagctgctcggcctgcggagcgccgtgcttcttggcctgctcggcccagtagagcgcctcgtgcgcgttatgcggcgtgccttcgccgcgtgcgtacaggatggcggtgttcatcatgcacgctgcgttgccgccctgagcggccttgagaaaatactggaaggcgaaggccgcatcctgcggaacgccggtaccggtgctgtacagccatgccagacggcccatcgccagcacgttgccgcggtttgcggcaatctggtaccagcggacagcctcgtccatgtccttctccaagccgcggtcgcccgtctcgatcaggctggcgattagtgccgcagcctccggatgaccgtattcagcggccttgcggtaccaggtgagcgcggtctgctgattctttttcacgccaaagcccttgtcatggtagcacgccagattgaacatagcaaccggatcgttttgctcagccgccttttttgtccattcaaaggcattctcagcattcttttctacgccctgtccgcgctcatacagtgagccgagcgcacgctgcgccggtgcacagccgtcctccgcaagagccagccactgaccggctgcttcggcaaaattgcctgccttatatgcgtccagagcctgctcgaacgcctgttcaatgctctgctgattttccttgttcgcttccattgtttactcctccagacagtaccgccttcgaaatatgcggtatgcagatatcttattctatcacaccgcacgtcgaaagtctatgaaaaaagcggaagaaatagcatggcataactgtatcttgacaaaaatgtgaaatgtgtgtgaatggacttgcgctttgcgctgaaaaaacgtaaactggaaataggatttcttaaccagggtatagattgtaaaacaacggcactctatcagataaaaggagaatgtcaaatgggacttatcaaagcagcagcaggcgcgggcggcggtgtgctggctgaccagtggaaggaatatttttactgtgatgcgataaacgcggacgtgctcgcggtcaagggccgcaaaaaggtcaccaagcggtcgagcaacaccaagggagacgaggatatcatcacgagcggctcggtcatcgcggtggcggacggacaggcgatgatgatcgtcgatcagggcaaggtcgtggaagccgcattcgagccgggtgagttcgtctacgattcgtccgccgagccgactattttcgccggttcgtttggtgacagcgtatgcaaaatgttcgccaacatggccaagcgcttcacgttcggcggagaagcgccgcgcacgcagcgcgtctactatttcaacaccaaggagctgaccggcaacaagtacggaaccgcgtctccggtgccgttccgcgtgctcgatgagcgggcgggcatcgacatggacattggcctgcggtgcttcggcgagtacagctacaggattgtcaatcccatgctgttctataccaacgtgtgcggcaacatggcagaggaataccgccgggaaaatctggacagccagctcaaaagcgagctgttgaccgcgctgcagcccgcctttgcgcgcattggtgcaaacggtgtgcgctactcggcgctgcccgcgcatacgatggagattgcggacgcgctcaacgaacagctttcgtccaagtggcgtgagctgcgcggcatcgagattgtgtcgttcggcgtcaactcggtcaaggcggacgaggaggacgaaaagaccatcaaggaaatgcagcgcgaggctgcctaccgcgatccgacccgtgcggcaggctcgctcgtgcacgcgcaggccgaggcgatgaagtccgcggcagcgaacgcgaacgccggtccggcgatggcgttcatgggcatgaacatggccggtcaggcaggcggcgccagcgtgcagaatctgtacgcaatgggtcagcagcaggcgcaggcggcaggcgagtggacgtgctcgtgtggacagaccggcaacaccggaaaattctgcatgggctgcggcaggcccaagcccgagcagaacagctggaaatgcgtttgcggtacggtcaataccggcaaattctgctccgaatgcggaaaaccccgaccggagaatacggcctggacgtgctcgtgcggcgcggtcaatcagggaaagttctgctcggagtgtggaaaagcaagaaattagtaattaggaatgaggaattagtaatgaaacgtaggggcgcacattgtgcgcctgaaatcaaacggtatgcagatggtttacacgggcggccgctgaccgccccctgcggaacacgttcaccataaataattactaactactaattcctaattctccaaaggaggatagaaatgtcagacaaagcaacaaactaccaatgcccgtcctgcacgggaccgctgcactacgacggcgctgcgggacggctgcaatgcgactactgcggctcgtcatttgacccggcagagatcgaaaagctgtacgccgaaaaggaacagcaggccgcttctcagccggagacggggagcgacaccggcgaatggcagtcctccgcagatgaggactggggcacagatgcggacaagatgcgcgtatacagctgtccgtcctgcggtgcgcagctgatctgcgaggagaccacggcggcgacctcgtgcccgtactgcggcaacccgaccgtcattcccgaacagttcagcggcattctcaagccggactacatactgccgttcaagctgagcaaggaggatgcggtttccgcgctcaagcagcattacaagggaaagctgctgctgcccaagctgttccgcgataataaccatatcgaggagctgcgcggcatttatgtgccgttctggctgtttgacggcgaagccgaaggcagcgcgaattacatggcaacgaccacgcgcgtgttccgtcacggagacacggaaatcaccgagaccagcttttacgaggtgcagcgcgcgggtacgctgccgttcagccgcgtgccggtggatgcatcgcgcaagatgccggatgattatatggattccatcgagccgtttgattatgccggtctgaagccattttcgaccgcctatctgcccggatttttcgcggataagttcgatgtttccatcgaggagagcagcagccgcgcggacaaacgctgtcggcagtcgctgtcggatgcgctgcaggggaccgcgcgaaacggccgtccgtatacctcggtcatgccgaccggagaggacattcacctcaaacgcaccggcgtgcattacgcgctgctgcctgtctggatgctgaatacccgctggaacggcaagaattacatgtttgcgatgaacggtcagaccggacgcatggtcggtgacctgccggtggacagaaagcggttctggggtctgtttgccgccgttgccgcgcctatgactgcggtgctgacggcgctgctgtattttctgtaaggaggcggcgtagatgaaaaacaagagaaaactgcgtctggctgcgctcttggcagtgcttttgctgctgtttccggcctttgcggttgaggacgatataacggatgagagcgacacctcgaccacccagacggaggaaactgaccagaccgcacagctcggcggcacggattccattgacccgtcggcagacaagccgcgcgtgttcgactatgaagaggtgctgacgcagccccagattgacacgctcgaggaaaagaccaaggcgatcgcggagaagtacagcatcggcgtcggcatcatcacgattgacgactacacgccgtacggcgacggcgcttacgacgcggcggagcagctctacaacgagcttgatctgggtgcgagcgaggacggcgacggcgtggcgctgctcatcagtctggatgaccgcgattttgcgacctatgcgcacggtgcgaaagccgaagagattttcagcgatgcggtccagcaggatttggagcagtatttcctggataatttcggaaacgacgactggtacggcggcttttcggacttcgtttccggctgtgagtggtatctgcagcatgtcgccgaaggcggcgaagccggtgtgccggtgcataatgaggtcgagatttcggacagtacgcaggaagacacagcggacgattcgttttcgctcggcggtgcattcggcctgtcgctgctcatttcgtgcgtggcggcgctgatcgtgtgcatggtgttccgttcgcagatgaaatccgtgcgtacacagacaaccgcaaaccagtatgtgggaaacggcggtctcaatctgacgctcagccgcgatatttaccgttatacctcgcagaagcggcggcagattccgcggaatgacaataataacaactcaaccggcggcggtcacggcggagccggattttccggcagcatcagccataccagcagttcgggacatgggagaagcggtaaattctgaatggaaaatggagaatgaatatagctgcattttccgtaaacaaaaagcaaaagacagccgacaggctgtcttttttatgcaaaaaacggagataattccgcaatgttcgcaatcgctttggattcctccggaaagtccttctgcagccttgcggcacaccgcctgcagaaatcctcatacaactcgggattctcccgcatttgctgcttgaagccccagatatgggtaaaatatccgttctgcgcaccgccgaacagcgcaggcaggtcactgagggcagccgcgtgcgcgtgctttttctcggcgcacatggcgagcagccgctgctcggcgaacaccatgtaggtgagtgtgtcgtcggcatccggtgagcagcgcatgaagcggatggcggtgtccgtgtagtaccgtcggaactcgtcattgccgaaataggcgagtgcggtattgaacggctgtaccgtccagtcaaatgaatcaagcgggaagccttcggttttggcgaatgccgtttgatccggatagatggacggcataatgtcctcgcggtggatggctgcggtgtccggtccgtcaagcagattgctgatggatttccagcagatgaaatctgtatcaagcatcacacacggcgatggcacagcggagagtgcgtacagcttgccggccgcccagaaggctgtggcgtttatgtcctcgggcatggtgtccaacagaggatacacgccgtcatcccacaaaaaacaaagcccgagcgattcataataacgcttggcaggtgtgtcgcagatcatgcggatcgaaccgttctctctgcgccactcgagcgcggaaagcgcggtcgtgagcagttcaaacggctcgattcggtattctatatggggattgcggatgaaaaatggtcttgtccagttggagtggaacgcctgcatcagatcagctccaatccgtagccgccgaccgggcacgagccggaaccgaaccggaacgaacctgatccggaaccggaataactggtgcggtaagaggtggtgtacgaggtcacatacgagccggagcctgagccgcacggcacgcaaacggtctgtataacggtagtttcaccggatgcggagacaacggtttcctcacccgctgtcgaggggacagcgccgcccatgatgggtaccggcgggcgttcgtcatcggccggataccagccctccgggtaggggtccaccgcgaaaacaggtgctggtgcggcagactgtgccggctcgcttgcttcgggtgcggtctcgggagagggtgcttcttcggttttcggctggcaatgccgcgcatagctggcttcatcgaacacaacgccgtcgatctcgcggtatttttccggattcattgccagaataccgttcggtttggacataacaccacacacctctcattcactaatataattatatatgaacacagtgaaaaccgcaacggggaaaaggggtaaaattttggctttacaatccgcagacggttttcgtataatagtagggagaaaacagatacggtgttccggtcggtttattatgctgtgccatgtaaaatattgtaggggcgcgcattgcgcgtccgttttatcaggttggcacaatatccattctgcggattggattaaacaattaccgtagggcaagagaagctactctggagtgcctcgccctgcggtaaaagttagttaaatgtcatttgtatatagaatgggagaaattatggactttttatcagtagagcagtcggtctggcaccgattgcaggaagaaacgcgcccaatcgcgctgtacggcatgggcgacggcgcagacaagatactcgcgcagtttgaccgtctgggcattcgcgcatccgcggtgttcgcgagtgacgaatttgcccgcggcaacctgttccacgggttctgcgtgcgcaagctgtcggacacggtagccgagcttggcgaggacattgtaatcgtgattgcgttcgccagccagagacccgaggtgctgcagctgatgtatgcgctcgaggacaaatacgacgtggtggcgccggatgttccggtggtcgagggaccgctgttcgacgaggatttcgtgcgcgcgcatcaggacgaaatgcagcgggcgtatgatcttctggcggatgatttgtcgcgcgaggttttcctcgatacggtgcgcttcaagctgtccggcaaaatggaatacctgcgccacagcgaatccgacaaggatgaggtgtttcataatcttctgcgcccgaccgcagaggagcacttttccgacctcggcgcatacaacggcgacaccatccgcgagctgctgcactacacggacggcaagtttgcgtccgttaccgccctcgaacccgatcgccgcagcttccgcaagctgaatgagtgggcgagtgccaatatcacgggcgatgttacgctcgtgcaggcgggcgcgtggaacgaggacacggtcaaatgcttcaccgatcaggcaggccgccagtcccgcgtagcggggcagggcaaagagacgcagatgtgtgcgctcgacagcgtgctgtccggccgcccgtgcacctatctcaaaatggacgtggagggcgcagagcgcgaagccatcgccggcgccgagaaaaccattcggcagtacgcacccaggctgaacattgctgcctatcaccgcagtgaggatttctttcagctgccgctgctcatccatgcgctgcagccgagctaccggctgtatctgcgtcaccatccttatgttccggcgtgggatacgaatttgtacgcaatataaaaaacagtggaaatcccggtcgggccgttgtataataaagatagattacggcagggtgtgacctgccggagaatttatacatgaaggagatcataacaatgggctgtttttactgtgatgagcaccatgagggccgcgaagcaatcatgtttaaggttggcgacatgaaggcaggtaccctgtacctgttcaaggatcaggcacacaagggccgctgcgcactggcgctcaagagccataagaaggagctgtgcgagtgcgacgagcaggagcgcaacgattactgtgcagatctggctgctgcttccggcgctatcaagaagctgtggggctgcaccaagatcaacctcggttcgttcggcgacagcaatccgcacctgcatttccatatcgtaccgaagtacgagggcggctttgagttcggaggcagctttgccatcaccaatccggagccggttatcctgaaggacgaggagtacaaggaaatgatcgaggctctccagaaggagcttggcctttaatcctttggctgcataagtcacaaacagcatcgaactttacggttcggtgctgttttttgtcttatatgatacttgcgcactgcgggaacgtgcggtataatgtacagtgatttcgtattgtataaacaaaggagcaatgctatgaaacgctatcttgcagcggcgatgctgctgcttgcgctgtccggctgcggctcaagcggcagcagtacacagctttacactaccaccgaggacttttttgcgatggacacctacatgtcggtcgatgtgtcaagcgaaaagagcgaaagcgcggcagaggacatggctgtcaagatcgagcagcgcgtcaatcagctggacgcggcgctctcgcgcacgcagcaggcgggcgatctctacaagctgaaccacgcgaacggtcagccgaccgaggtgagcgatgacacctacaccgcgcttgagaaagcgctcgagtacgccgagatgacaaacggtgcgtttgacccgacgatggcgccgctgaccgacctctggggcatcggcacggacaacgcgcgtgtgcccgcgcagagtgagattgatgaagcgctgacgcatgtcggctatcagaacgttaagctgctcggcaacaatcaggtgcagctgctgaacggcgcacaggtcgatctgggcggcatcggcaagggctacgcaggcgacatcgtgcatgaaatggcggagagcgatacctcggatcagtggcacgttctggcgcggctgagcggcaatattgagatgtacggcggcaaaaccgcagacagcggcacggataactggaacatcggcattgccgatccggacgacaacacggattcgattgcggtggtgtcgctgcgtgacggctcggttgttacctcgggtgattacgagcgattttttgaaaaggacggcaaacgctaccaccacatttttgaccccgcaacagggtatccggcggacagcggcctgcgtggcgtgaccgtcattgatccctgctcgaccaaggcggatgctctgacaacggcgctgttcgtcatggggctggataagggcatgaaattctgcgaggagaacgagattgcggccgtgttcatcacctcggacaagcaggtgtacaccacgagcgcgctgggcggctatgtatcgttcgagttcctcggtgcggaaaaaggatttaccctatgctgaacaagctgaaattcggtgattttattatcatcggcgtggttctggtgatggcaggcgcgctggcggcagcgctgacgtttcacagctccggcgacaagctgtacgccgaggtctggcagaacgatacgctcatcgagcgggtacagctgaccgacgcgaccgaccgcacgatcaagctggacggcaacaccattgtgctctcgggcaaaacagcgaaaatggcggacgcggactgtcgggatcaggtgtgcgtgcgcaccggtacacttactcatgccggacaggcggcggtctgtctgccgcaccgcgtggtgctcaagctggtcggtgtgaatgacagcggcatcgatgctgtggtatcgtaaggggtgcagcatatgaaaaatgcaaaacgattgacgctctgcggcatgctggcggcggtggccgtcgtgctctcgctggtcgagcgcatgttcccgctggatgccatcgtgcccgtgcccggcgtcaaattagggctggcgaatgtggtgacgctgtttgcgctcacgcggctgagcgcgagagacgcattcgccatcgtggcaacgcgcgttgcgatttcctcgctgctgatgggcagtgtgtcggcgttcctgttctcgctgttcggcggcctgctgtcgctcatcgtgatgagaatcctgctcaaagccgaaggcaaattctgctcactgttcggcgtgagcgtaggcggcgctgcggcgcataatatcgggcagatggcagcggctgtgatctggctgaaaaactgggccgtgatcgcatatctgccgttcctgctcgtgatgagcgtgccgctcggattggtgacgggactgacctgctcggtcgtgttacatcacctcaaaaaaattgatttcagtgcataaatttgaaaaagcagtctcatactaacgaaaacagattaggagggactgctatgaaaaagctgatcgccctgctggcggcgctgacgatgctgttcgtctgcggctgcggcagcaacagcaaggataacggcacagacaacggcaatggtaccaacaatggcaccaacaacgctgttgatgagcggcgcgacaccaacacgaatactgtcggtgatgacgtccgcgaaggcgtggacgatgcaggcaatgccgtcggagacgcggtggacgatgttggcaacgccatccgcgatggcgcagacgccgtgaccggagataataataacgcggcgaagcagccgaatacggcgaatgggacgaatgctccggcggagaatccgtaaaacagaaacggcatggcgtaagctgtgccgtttcctttgttttgctgcaccgattcactggggcacacgagttgcgtcagcaatacgccctgtccgggcggcagatttttgctgaaccgcagaggaaagttgcgctctgcggagcgcgggagactgccgcgcccgcggctggggcaaaaaggaagggacacctgcggtttcccttcctctttgaactcctacctttcccttatttcttatcctgacgcaaatcagagaccggcgactgcttcgaaataaggggaacggcagtcgggttacttcagcgtgtctttctccaccttttcgcagttcacagacagcgtactgctacacatgtgttttactctacgcaggcgcggcatgacagtgccgcgcaacccttttgcacgttgtaacggaaggcacctgcgaagtcagacgttcggtaccatttattctcgcaggtgctgtctatcacaactcgctaacgaattgcgcggcacggttatgccgcgcctgcgtagagtagccgacctgtgtagcagtaagttatctgacgctgcgaatacgcggatacatggacggctgtcagccgtcctgcggaagaaaagatcctctgccgtactccttttcgaagcggtcgccggtctctgatctgcgtcaggttaagaaacaaagggaaacgggagttaagagggtagaaaccgcaggtgtctaccctcttgcccgcagccgcgggtgcggcgaacctccccgccaaaggttggcgcccattctatatgcgcaggaagcagcgaaaccgcagtttacgtcttgcacagaccgcgatcgtgtgctaaaataatactattatgggaaaaacactcgtggagcgcacaaatcgcgtctccgcgcagtctaacgagttggagtgagagataaatggattacaaccgtttggcggaactgctgtttccgcatatcaataccacgccggaggagatggaggctcgctatcccaagcgcgagctgcccgagggcgcaaaggtaacccgtatgggcccgagcccgaccggcttcatgcacctcggcaacctgtacggcgcactggtggatgagcgcctggcgcaccagtccaagggtgtattttatctgcgtattgaggacaccgaccgcaagcgtgaggtagagggcggcgtgcagatgatcatcgacgcgttcaagtcgttcggcctgccgttcgacgagggtgcaacgactgacggcgagaccggcatctacggtccgtaccgacagagccagcgtgccgagatctaccagaccttcgtcaagtcccttgtgcagcgcggcatggcgtacccgtgcttctgcaccgaggaggagctctccgccgcgcacgagcagcaggagaagaacaaggaaaacttcggctactacggcaagtacgccgtatggcgcgaccgtccgatggaggacatcgaggcagagcttgccaagggcacgccgtatgttgttcgtttccgctcggagggcagcattgagcacaagatccgccacgaggatctcgtaaagggcaagatggaagtcaccgagaacgatcaggacgtggttatcctcaagtccgacggcatcccgacctaccactttgcgcacgttgtggacgaccatctgatgggcacgaccgtcgttgtccgcggcgaggagtggctggcaacgctgccggtacacctgcagctgttccgcgcgatgggctggaaggcgccgaaatacgcacacaccgcccagctgatgaagatcgacccggagaccggcggcaagcgcaagctgtccaagcgcaaggacccggaactggcgctgacgttctacgcgcaagagggctatccggtaccggcggttctcgagtacctgatgacgctcctcaactccaacttcgaggagtggcgccgcgcaaatccggacctgccgatgaacgatttccagtttaccaccaagaagatgagcggctcgggtgcactgtttgatatcgaaaagctgcgcgacgtttccaagaacgttatttcgcgcatgacggcagagcaggtatacgattacgttgccgagtggtctgctgtcaacgacaaggagtttaacgcactgctgacccgcgacccggcattctccaaggcgtacctcgccatcggccgcggcggcaaaaagccgcgcaaggatcttgcgctgtggtcggatgccaagggctacatggacttcatgttcgacgagctgttccagccggattacactatgccggagcgcgtttccgccgaggacgccaaggcgattctgagcgattttgcaggcatgttcgacgagaacgatacgccggacggcttcttcgacaagatgaagcagatcgcttctgcacacggctatgcagccgataccaaggcgtataaggctgacccgtccgcctataagggcgccgtcggtgatgtgtccatggttgtccgcgtagcagtggcgggccgccagaacgcaccggacctccagaccgtaatgggtattctgggtaaggaaaaggttctggaacgcctgtctaagtgcgcagatgcgctttgaataatggaaaatgtaaaatggataatggagaatgaaggagccgcccaaagggcggaattaaatcatcgcgcgcagcgcgataccgcaattttcaattttccattttcaattctcaattccaagggagaataataaatgttagagaatgtaaacaacttcctcacagaaatcatcgacgaggatattaaaaacggtctttccgagcgcatccacacccgctttccgccggagccgaacggttatctgcatatcggctcggcaaaggcgatcttcatcaactggtctatcgcgaaaaaatacaacggcctgttcaatctgcgctatgacgacaccaacccggtcaaggaggataccgagtatgtagactccatctgggaggacatcaagtggctgaccggcgaggagccgagcggcggtgtgtactacggctcggactactttgaaacctgctttaactgcgcggtacagctgatcaaggacggcaaggcgtatgttgacgatctgacacaggaggaaatgcgcgagtaccgcggctctctgaccgagccgggcaagccgagtccgtaccgcgaccgttcggttgaggagaacctccagctgttccaggatatgcgtgacggcaagtttgccgacggctccaagacgctgcgtgcaaagatcgacatggcaagtccgaacatgaacctgcgcgacccggcgatttaccgtatcgtgcgtgcacatcatcaccgtcagggcgataagtggtgcatctatccgctgtacgactttgcacacccgattcaggacgcacttgagggcatcacgcactccatgtgctcgattgagttcgagaaccaccgtccgctgtacgagtgggtggttgacaactgcccgctgccgcatcatcccaagcagcgcgagtttgcccgcctgaatgtaacgcacaccgttatgtccaagcgttacctgcgccagctggtatttgaaaagcacgttgagggttgggacgatccgcgtatgcctacgctgtgtgcgctgcgccgccgcggctacacgccgagcgccatcctcgattttgtacagcgcgccggcatcgcaaaggccaactcgctggttgacatcaagctgctcgagcactgcatccgcgaggagctgaacgagaccgcgctgcgccgcatggcagtcaccgagccggtcaagctggttatcaccaactatccggagggtcagtgcgaggagttcgaagtgccgaacaatccgcgcaatgaggaagcaggcagccgcaaggttccgttcacccgtgagctgtatatcgaaaagagcgatttcgcggaggttccgcctccgaagttccagcgtctcaagccggacggcgaggttcgtctgatgggcgcgtatatcgtcaagtgcaacgagatcgtcaaggacgacaatggcgagatcgtggaaatccgctgcacggctgatcttgagacccgcaacggcatgccggtggacggccgcaaggtcaagggcaccattcactgggtatctgccgagcacgccatcgatgcagacctgtatctgtacgataatctgttcaccctcgagaacgttaatgacgtaccggagggcacggattatctggattacctcaatccggattcgctcaaaaagctgaccggctgcaagctcgaaccgtcgctggctgatgccaaggaaggcgaacgcttccagtttgtccgcatgggttattactgcaaggaccgcgagagcggccgattcaaccgcattgttacccttaaggacagctttgcaaaaacgctgaaaaagtaagcacagataagaaaagctctctgaactttgttcagagagcttttttcgttagagatgaattgagaatggaaaatggaaaatgaaggagccgcctgaaaggcgggattaaatcatcgcgctgtgcgcgataccgcaattctcaattctccattttcaattttccattactgcaatcgcttaaatgatgcggctttcgatttctgcattcggcgccagaaccttcacgaagaactcgagccgccggagtgcgttctcgataaccgccttatcggtatccggcgtgccgaacacgggatggaacacatggcggctgtccggatggatgcaggttcggtcgtccgcaccggcgatcatgctgaaaatgatacccgagctatcgcgtccgcatatgtccttcgggtaggtatgcgtgcttgcggcgcgcatacccagaaacggcagcttttcgctcggcgtaaagatagtcagcggaccgtccatgcggtcaatgtcatgcgtgccggagagtacgaacgtggtcagctccagcaggaagggaacccccatcaccgggtcctcctccgggaacggacggcccttgaacagcacggattcaaactgctgcatgaccggataggttttcttgaacttcttgaagaagcgaaaatacgggttttcaccgaaaacagccttgcggtcgtagtcggcatacttttcgcgcagggcatccagttctgcgtgaacaaggtcgtaaaatttcgttatatcccatgcagaacggtcgggataggtgacttcgaggatgccgagcggaatattgcgctcggcaaaggtcgggtccttgatgatttcaaacataggaacacctcgatttgttaagcgggttcgtaggaactgtgataatcggcagcggcttcgccggtcagcacatcgtagtagtaccactgcgatttatccgtgctggtgaagaaatacacgccgagggggtgctctgcggtatcgctggtcagccgaccgacatattcgccacttgtaccgccagccgcttctccggtgcggatgatttcgtcaacggacaccggatgcagcacggcgatcatgccgagctgcgcgatggcgtaggacaggtacagcaggaagatggtgtaggcggactgccgcagcgaagcctcctgcagagggtggttcatgcacttgccgatcagcaggccgatgaaggacagcacgatcagcgccgcaatccaccagaagctgatctcatacagcgggttcatgccggacagcagggcaatgaacagcatcagcgccaccagaaagacgagcagcgcctgcgcccagcggctgtggtccctgccgtcgggattactgggtctgctgttcataaaaatgttgaagatgagcgcaaccggcgcgaacacccacagataggtggggaagccgccgacggcaccgtcatacacggtgttccagtgcatggcaagcaggcaggtgcccagccagacgatgaccgaagatacgagcagcagaagatttttcttggacttaaaaagattcatacaggaaattcctcttaaaagcaaacgggcagagccttgcggctctacccgttttgattacgcaccgcaaggcacgctctgttcagttaaaccgaaaagattaagcctcagccttgatcttcttcaggttagcgaagcgcggcagaccggataccttcgggccaacgttctcgccgttgatgagcggcagagcgtagtcaacgaactcctgcgttacgccgttgccttcctcgttgatccactcacgcggaaccttcttctcggtgttggcaacctcggacagcgggagcagctcgatctcgcacttgtagccgttctcgtcacgggtgcacttgaagcccggcatgtagtcggtcttgcctgcaactgcgttctcaacagcagccttgccggacatataggactcgtcaacgtcggtcttggaagcacagtgagcagcgcagcgctgcagcaggctcagctcgatgccgcgaaccttgcagcccagctcgttcttaacggtgtcagccagcatggaagccagaccgccgagctgtgcatggccgaagccgtcggtagcagaggtcttagcttcggatacgaaggagccgtcagcgtagtggataccctcggaaacagctaccaggcagttgcccttctcgtcgtagatgcgctttacgtcagccaggaacttcttcatgtcgaagtcggtctccggcaggtaaaccagatccggacctgcgcccatagcggtagccagaccggcagcaccggccagccagccagcgtgacggcccatgatctctacgatgcagaccatgccggtgtcgtatacgcgagcgtcctgatagatctccatgcaggaagtagcgatatacttggcagcggaagcaaagcccgggcagtggtcggtgccgaacaggtcgttgtcgatggtcttcggaatgcccattacgcggcactcgtagccggacttcatcatatacttggaaaccttgttgcaggtatccatggagtcgttgccgccgttgtagaagaagtagcggatgtcgtacttcttgaagatctcgaggatgcgcttgtaatcggtgtcgtcaacatccggatcagccagcttgtagcggcaggagcccagtgcagaggacggggtgtagcgcagaagagccagctcgtcgcggtcttccttgtcgatatcatacaggtcgtcgttcagcaggcccttgatgccgtgtgccatgccgaatacgcgggtgatggacggattgtccagtgctgcctccagcgcacccagaacagaagagttgattacggaagtcgggccgcccgactgaccgatgacgcaagcgcctttcagttcactcattgataaaacctcctaagcaaattaaaacgcagagcagtgccgtgcattttcttactcataaagagtaccatataatatgaaaaaaatcaatgaaaatcctgcgttttcggcaggtttggcaattctggcaaacctgccgcaggaattcagcgaaaaaatgacaggatttttttgatatggacttgattttagtatgcttaactgataaaataaaagcagaatttttaagattcagtttttatcagaaaggaagtattcccatgcctttagttactactactgagatgttcaagaaggcttacgacggcggctacgctgttggcgctttcaacgtgaacaacatggagatcgttcagggtatcaccgaggcttgccaggagcagcacgctccggtagtcctgcaggtatccaagggcgcacgcgcttacgcaaaccacacctacctcgttaagatggtagaggctgctgttatcgagtgcccggatattccgatcgctctgcacctggaccacggcccggacttcgagacctgcaaggcctgcatcgacggcggtttctcctccgttatgatcgactgctcctcccgtccgttcgacgagaacgttgaggagaccaagaaggttgtagagtacgctcacgctcacggcgttgttgtcgaggctgagctcggcaccctggctggcgtagaggatgacgttaaggtttccgctgaggattcctcctacactcatccggaagaggttgaggagttcgtaacccgcaccggctgtgactctctggctatcgcaatcggcacctctcacggcgcttacaagttcactccggagcagtgcacccgcaatgctgacggcgttctggttccgcctccgctgcgtttcgacgtactcgaggaagtttccaagcgtctgccgggcttcccgatcgtactgcacggttcctcttccgtaccgcgtgagtttgttgacaagatcaacaagttcggcggcaagatgccggatgcaatcggcattccggaggaagagctgcgtcacgctgcacagctgtccgtctgcaagatcaatatcgactccgatattcgtctggctatcaccgcttctatccgcgagcacttcgctgagcatccggatcacttcgacccgcgccagtacctgaagccggctcgtcaggctgtcaaggacatggttacccacaagctgatcaatgttctgggctgcaacggcaaggcataagatcattttctgatcgaaaccaaagaacctcggaatcctgttccggggttcttttttcatcttgtgatggagaatagaacggataccatatatagtgtatccgtttctcgcgggagaaattaccacagagaaaataaaggagaaactttgtggaatttgtcgcgcttttctgataaatttttcgagtcaagaggaaaagtttagagaatactccaataaaaatagtgcttttcttgcaaatgtgccaaaaagaatttagcgccttgacagggcggtgtttcggcgttagaatatataagcaagagataagcagacacaagatattgtgcgatatcgaatgcagcactacataatttcgtaaataatcaagaaatcgccgtcaggcggtttttgtatgagagagggatttttctttatgattcagcagatcgtcaagcgggacgggcgcatggctccctttgagatcgacaagatcacaaatgcaattttcggcgcagcacaggcatccggcggccaggaccacgatatggcgcaggagctggcggagcaggtcgaaaaaacgctggaggagactgctggaaccgaaactcccaccgttgaacaggtgcaggacactgttgagaaggttctgatcgaaagcggacatgcccgcacggccaagaagtacatcctgtaccgcaacgagcgcacccgcgtgcgtgagatgaacacccgtctgatgaaggtgtacgaggatctgacgttcaagtcctcgctcgagaacgacgtcaagcgagagaacgccaacatcgacggtgataccgcgatgggcaccatgctcaagtacggctccgagggtgccaagcagttctatgagatgtttatcctcgatccggcgcatgccaaggcgcaccgcgagggcgatatccatatccacgatctggattttctgacgctgaccaccacctgctgtcagattgacctgctgaagctgttccgcgatggtttttccaccggtcacggcttcctgcgtgagccgaacgacatccgctcgtactccgcgctggcgtgcatcgccatccagtctaaccagaacgaccagcacggcggtcaaagcgtgccgaacttcgattactcgatggcgccgggtgtgcgcaagaccttccgcaagctgttccgcgacaatctcgccaaggcccttgaggtgttcggcgaggacgacgacaacgaggtcgatgcacgtgcactgaccgagcgtgtcgagcaggagaccggcaagtgggcttgtctggcaggcggcaacggctatgatgaagcgatggcgaaggtactttccgagacgctcgatgaaaagacggttgcaaagtgcatgaagtttgcccgcaagtacgcggataaggaaacccgcaagaccacctatcaggcgatggaagcgctggttcacaatctgaacaccatgcattcgcgtgcaggtgcgcagattccgttctcgtcgctcaactacggcacggatacctcaccggagggtcgtctggtcatggagcagctgctgcttgcgaccgaggccggtctgggcaacggtgagaccccgattttcccgattcatattttcaaggtcaaggaaggcgtcaactacaacgagggcgacccgaactacgacctgttcaaactggcatgccgcgtttccgcgaagcgcatgttcccgaatttctcgttcctcgatgcgccgtttaacctgcagtattacaagccgggtcatccggagaccgaggtcggctacatgggctgccgcacgcgtgttatgtccaacgtgtgcgatccgacccgtgagattacctacggccgcggcaacctgtcgttcacgtcggtcaacctgccgcgcatcgcaatccgcagccacggcgatctggactggttcttcgaggatctcgaccgcaagatcgacctcgtaatcgaccagctgctcgaccgtttccgcatccagtgcggcaagcgcgtgcgcaactacccgttcctgatgggcgagggcgtatggctggattccgaaaaactgggtccggatgacgaggttggcgaggtgcttaagcacggaacgctgacgctcggcttcatcggtctggcagagtgcctcaaggcgctcatcggcgtacaccacggcgagagcgacgaggcgcagaaccttggtcttgagatcgttggtcacatgcgtcagcgcatggatgaggcaaccgagaaataccacctcaacttctcgctgatcgctaccccggcagagggtctgtccggccggtttgtcaagatcgaccgtgagaaatacggcatgattcccggcgttaccgaccgtgattactacaccaactccttccatgtgccggtttactatccgatttcggcgtttgagaagatcgcccgcgaggcgccgtatcacgagctgaccaacggcggtcatatcagctacattgagctggacggcgacccgacgcagaacctcgaagcgtttgaggctgtcgttcgcgcgatgaaggaagccggcatcggctacggcgcgatcaaccacccgatcgaccgcgatccggtctgcggctatactggcattatcggtgaagtatgtccgcgctgcggccgccgcgagggcgaaggcgttccgctgtccaagctgcagaagctgggactgtataaaaattacaacagcaccacgatcggctatcacggcgaccctgccgaagaagccgaccgtcagccgaatacattgaaaatcgtcaaaaagtgacaggaaagggagcattctatcatggaaactaagaatatcgctgcacaggagccgatgattggtgaaggtgtaggctttgaacgtatccgccgcattacgggttatctggtaggcacgctcgaccgcttcaacaacggcaagcgcgctgaggagcacgaccgcgtaaagcacagtgtttcgagctgctgctccatgcgtcaggagcacaccgcctgatggaaggtaaaatccgcattgcaggtacagtcggggagtccattgtggacggccccggcttccgctatacgctgtttgtgcagggctgtccgcacggctgtccgggctgccacaacccgcagacgcacgactttgagggtggtcaggatattgagctggacacgctgctgaaggatatgtgccgcaatccgttcatcaagggtgtgacgttctcgggcggcgagccgttctgtaaggcagaaccgctgtatcatcttgcggtggagctgaagcgcaagggcaagcacctgatggcgtactcggggtacacgtttgagcagctgctggagctgagcgatccgtttgtgaaaaagctgctcgggcagttggatttactggtagacggaccgtttatcatggcggagaagaacatcgagctgcggtttcgcggcagcgcgaaccagcgggtactggatgtgccgaagtcgctggaggcgaatgaggctgtctgggcggagcagtatcgatgattatcgtttggcaaacggagaaacgcgccgtactcacggtgtgtggggaattgcggcggttgcgccgcggcaacaagagggtagacacctgcggtttctaccctcttgactcccgtttccctttggaatagcacggcgaaattttcagaactgagactataaaggaacggcagaggatttttttctgccgtaggggagcacagtgtgctcccatttctttacctctgcgcaatgccggattccgtactgctacacatgcggtttattctacgcaagcgcaacataacagtgttgcgcgactctttttcgcgttattacggacggcacctgcgggtttcatttaatgacggactttaccgtagggtgcggcaaggtgaattgtccgaagggcaagagaaggtgccctggggtacgaccttggcgcactgtgtaaaccgcatgcaccattgctaaacaatgcgtatcgcacaaaatgataacaaaagagcaccgaaacttacgtttcggtgctctttttattttctgacagttcattttctgattctgccttctccgcaaggtgcggattccggaccacacaccgtacacacggtgcggtcttgccgaaggcggtatagctgaccttttcggtcggctgcatatggcaggcaacggcggtatgcagccctgcgagatcatccttctgcacgaaggcgctgacctcgtcggcatgcatggactcaaacgcgtacagcaggcacgcggcgatgcactcgcggccgacgccgatgccgcgcagctcatgccggacgatacagttcgcggtcagcacgcgttccgcgccgacctgctcgtaagtcaggccgcacagagccgcgggaacgccggtcggtttatcaagtgcgagcagccagccgcagccctcggtctgatagcggcgcagcgtatccaccagccagtccagcgtctgctcgtaggagagtgcgccgccgagcgtctgcatggtctcctcgctgcgcaggagcggcgtcagcaggttgaggtcatccgcactcagctcgcggtagtccatgcggctggagtttagttcgtaaaattgcataggttcaattttctcccaacaaaacggtgcggctcgaaagccgcaccgcaaaagtgtccttaaaagtgtctctatctgtttcgataccagaatacaaatttgcgcaccagtacgcccagcgttaagccgaccagcgagggaacaagcccgtaaaacaggctttgcatctcagtcgagcggaacgtggcaagcggcagaacaatcgcccacaggccaacgaacacgggcatcagaccgtatcgcggcaaggcgcggtatgccgcccggaacgtacacagcagcgccgaaaccggcaggatcagccagaagccgagcagccagtaggcaaattcattgccatacagcagaccggggatcagcccgaccgccgtcacgacgccgtagcaaagggcaaggctccaatacggggataaacgccggataccatcaaatgtcatgtggttcaccctcctttgcagggatggtcggtgtgaaattgtactgcagataccgaaaattcagcggtatattgcttacttggtgccgaagatacggtcgccggcgtcacccagacccggaacgatgtagccgtggtcgttcagcttctcgtcaatgccggcaacgaagatctcaacgtccggatgagccttctgaacagcggcaacgccttccggtgcgccgatgaggttcatcagcttgatgtgctttacgccgcggcgcttgaggccgtcgatggcagcgatagcggaaccgccggtagccagcatcgggtcgagcagcagtacgtcgcgatcctcgatgtcattcggcagcttgcagtaatattcgatcggctgcagggtttccgggttgcggtacagaccgatgtggccgaccttggctgccggaatcatctccagaatgccctcaaccatgcccagacctgcacgcaggatcggcacgagcgcaatcttcttgccggaaataacctgtacgcgcgcctcagcgaccggagtctcgatggtgatctccttgagcggcagatcgcgggtagcctcgtagcacatcagcattgcaatctcagcagcagcctcgcggaactccttaacgccggtggtcttgtcgcgcatcagcgccagcttgtgcttgataagcgggtggtccatttcatgtacggttgccataataaaaatctcctttatcctaaaacttttttgcttcaggcaatatcgcataattgaacaagagcgatttgcgagtgggttttgcgcactgacaaggcgcggttttgcagtaatactttgtgtattaccgtgaaatcggaacaaagtcaggatacaaaatttccgcaaagcgccgcagcttaattgtgcggtgttgtctgctgtttggtctgtgccagacgcgccatgcgctcgcgctctgcctgcggacgacgcagatagaaggcgtccagctccttgggggagcaggctttgccctcgcggaacagggggagtgcggcggcggcaacaccaaatccggtcgcaaaccgcagctcggcgggtgcgagccgcagaccggtgcagttctctttgatagtattataacacagatccgcgccatctccaaccagaaaatacggcgcttctccgatttcttcggcaagctcggtcagcttgatcgcacggtcatcgcacagacggcgtacgctgccgtcctctacggtgaaaagcgcgttgtaaacctgacccgcacgcgcatccatcacgcagcacaggtcgccgccgagtgcgcgggcgccccatgccattgcctcgagcgtggagacaccgaggcacggcttgtccgcgccgagcgccagacctttgaccgtggccacaccgatgcgcacaccggtaaacgagccggggccgtgcgcgacagcgattgcgtccacgtcagcgagcgatacgccgcagtttgccagcaggttttccaccatcggcagcagcgtgcgtgagtgcgtcaggccgcagttctgaaaggactgcgccaccagtttttcgtcctcggtgagcgcgacagacgcgctgaccgccgaggattccagtgcaagaattttcatacagtcacttctccaatcgtaatgcggcggtcgttgtccgcatcgccgtaggcaatatggacggttttgtaggcttccggcagaacgtctgcggcgttttcgctccattcgatgagcacaatgcggctgccgtcgagatattcgtcaaagccgatctcgaacagcgcttcactgtcgagaatgcggtacaggtcgaagtgcgcgaccttgaccgtcggcgtttcgtattcgtttgcaatggcaaaggtcgggctggtgacgcggcccgcgtagccgagtccgtgcagcacgccgcgcgtgaatgcggtcttgccggcaccgaggtcgccggagaacgcaacgacatcgcctgccttgaggctttttgcgtattctgcgccgagtgcttcggtctcctcgggtgagtgggtgatatattccatgaaaacacctttctgtcaatcataactatacatttataatataccacggtacactcggaatggcaagtcagcctgctgcaaagtataacttttttatgacatttccgcttgtttgcttgcgggatggcataagttgtggtaaggtataaaataatataaggcaacaccgcacaattaaagcggcggctccttgtgcaggctccggtcgcactgccgcggtgctttgcggaaattttgtgtcctgactttggcttcggttccttgcgcgagttccgtccgcgctgccgaagtttcacggtaatacatcaagtattaccgcaaaactgtgtctcgtcagcacgcaaaatttactcgcaaatcactcttgttcaattatgcggtattgccctaagaaaaacggaacaaaaattttaaggaggaaaaccctgtgatagaattgctcaaagcatttctgttcggcattgtagagggcatcaccgagtggctgccgatcagcagtaccggacacatgattctgctcaatgagtttgtaaagctggacgtgtcggaagcgttttacagcatgtttgaggtggttattcagctcggtgcgatactcgcggttgttgtcctgttctggggacagattttcccgtttgagcggcgaaagggccgtcacggcggcgcatccatcgtgctgaatatggataccgtcaagctgtggatcaagattctggtagcttgtgttccggcggcgatcgtcggtctcaagtggaacgacctgtttgaagaactgttctacaattaccagacggtttccatcgcgctgatcgtgttcggcgcagcattcattctggtggagaacgcgcacaagggcaagtcggcgcgcatcaacgcactcacggagcttacttacccgaccgtgtttatgattggtatgttccagctgattgcggctgtgttcccgggcacttcgcgctccggcgcgaccatcgtcggcgcgctgctgctcggcgtatcgcgtaccgtggctgcggagtttacgttctttctggccattccggtcatgttcggcgcaagcctgctcaagattctcaagttcggctttgcgtttacatccaccgagctgatgatcctcggtatcggtacaatcaccgcgttcgtgtcctcgctgctcatcatccgtttcctgatgagctttgtcaagaagcacgatttcaaggtgttcggctggtatcgtattatcctcggtatcgccgtgctggcgtactttatgctggcgaagtgaatagggaaaagaggtctgcggggcagacctctttttgaggctgtcgaaaaactatcgttttccgagcagcctctcgctcgaaaccacgctttcgagcgaatactgaagaaaaaccgcgccctgacgggcacattttttcttcccttgtataaaaagtcaggtacacgccccgactttttatgaatttgcttcgcaaattctattttatgcgtgctgccgcacgaagcgtaaaaattaaaataatatttttttgacaaactgaaaagaggtctgcattgcagacctcttttgttgtatggtttcctattaggtacgctgctccaatccgtgccgaatccttctccaaaccacgcacgacagcgcaatagtgacataatccgtgatggactgtccgagaactgcgccattcagaccgaaaaccgcattcagcagatacagcaggggaatgagcagcagaccctgccgcagcacggacagcacggtagccggaagggcgcgtccgaccgactgcatacagttcatattgacgaacagaaaaccgatgaacgggccggacagcatgtaggcgatcagcatctgcacgccgtatgtaataacgccgctgtcgtccacgaacaggccgatgatcggcttgcgcaggaagaaatagagcgcggttgccgccaatccgacaacaaagcagcacagcttggtaaaacgctcggcatcggcaaaacgcttgatatcacccgcaccgtagctgtaaccaaaaatcggctgtacaccgtttgcaaggcccatttgcaggaaggtgatgaacatattcgctttgaacacaatgccgatcgccgcaacgggcgcgttgccgtaggcgaccagaatcaggttgagcacaatggttgaaacacacatcagcgcggagaagatggcggtcgggaagccggcagagcacacgcacacggcaatgtgcgtgccgcagagcgcgtccttcggcgcaagcgaaaaccgccgcgactttttgagaaaataccacaggtagtacagcgccgcaagcatattgccgatggtggttgcaatggctgcgcctgccgcgccctgtcccagaccggagacgaaaaccgggtcgagtacgatgtttgcaatcgtgccgatcatgctgccgatcatggcctccttgctcgcgccttccgcgcgcacaacgaagctggctgccgccgaccagatgacgaacggtgcgccgaacgcgatgtaaaccgtgtagccgcgggcaaactcaaatgtgcttgcgtccgcgccgaacaggtgcaggatgggcgcggtgaagcacagcagtacggcggcaaacgctgcgccgacgatcaagctcgcccatgagatgaacgaggagattttcttcacgctttggtgattgttctcgccgagcgcgaccgagatcatcgcactgccgcccatgccgaacatgttggcgaacgccatcagcaggatgaagatcgggttggtcaggctgacggcggctacctgcagggcatcgccagtctgtccgacgaaaaaggtgtctgccatgttgtacaccacggtgacaaggctgctgatgacgctcggaatcgccattgcggctactgcacgaggtatcggcgctttgccgaggagagtatcattatccaaattgttcacgttccttactttggaaatttaacgattgtttccatcgaagcggcagggcagcccgctctgcggtaagggttaatcgttttttttaaaatttgaaagcattttcagcccaatccgcataaatgtgtcccgctcctcgggcgagatgtcgcggagcagcatggattcggtctccgtaatctcctgcaggcaggcgggacggaaggcttcggctttttcggtgcagacaatgcacttgcgccgtgcgtccgcaggatcgggttcgcggcggatgagatcggcagcctgcagggcctgcagcatttcggttgcggtggaaggccgcaggccgaattcctgctcgatatcgcgctgtacgagcgggcgcttttgactttctattaaaatatagttgagtatctgacctttggtgccgctgatgtgaatgcgcttttgcgtttccgccgaccggcggcgcaggcagttggatagcttgttgataagccgtccggtatccatgaaatcacctcgcttaattacttcgtttcctaagtaatattgtagtcggtgattgcggaatgtcaagagggaattttactgcttgcccggggagatgggagccgtccggacggctcttttttcctgcaccggatgaccggggcacacgagttgcgttagcaatacgccctatccgggcggcgcctttttttcggcacagattgagcggggcacgcgaactgccgcaggcgggttcgtcctgacggggcggagagttttccgctgaacctcagcggggggtgcgctctgcggagcgcgggagagtgcggcgcccgccgcgggggcaaaaaggaagggacacctgcggtttcccttcctctttggactcctacctttcccttgtcagttagtctggcgcagattgccgacatgtgaccgctgcgaaataggggaacggcagaggattttttcttccgtgtctttctcgacttattcgcagtgtcagatacattactgctacacagaccggctactttgcgctgggtgcggcataacagtgccgcacgattcgttggcgggttatgatagacagggcctacgaagataaatggtatcaaacgcctaaattcgcaggtgccttccgtaaacaccaaactaacgagttgcgcaacactgttatgttgcgcctgcggagagtaaaccacctgtgtagtagtacgctatctgtgaactgcgaaaaggcggagaaagacacgctgaggtaacccgactgccgttcccctatttcgcagcggtcacatgtcggcaatctgcgtcagaccctctaagggaaaaggggtgatccacaagagggtggaaaaccgcaggttgtctaccctcttgtgcccctgccgggcaggcaggattccgcttgcttcgtaagcaacaaatcaacatttcagcagaaactttcctattgacagcctgtcgcagagttttatacaataaaacaaaacaacgaaacgaggtgcctgctatgcacatccaccatttagcgctccgcgtgcgcgatttcgagaaatcgctgcatttttaccagacgctcaccgagttgaagattcacacgcagttctccgcgaacggcggcagcattgcttatctgcagaacgccaacggcgaaacccagctggagctgatcggcatgccggagggcgagaccgtcaaggcgtccggcatgttcctctgcttcggtacggaggatatcgccagcgcacatgagcgtgccgtcctgcacggcatgaatccgtccgatatccgtcagccggagccggacgcgcgctacttctatgtttatgatccggacggtctgtccgtgcaggtgcgtgaatatccttaaaacagatttttaagcgtcggacgctgcacctccggcaaatgcctcagctgagcgagcagctctgcgcggtcaagcgccaattcgtccgtcaagccgttttgctgcgcggcaagtacacggtcaaacagccggtcagcctgatcaatctcgctgtgcagcagcagagcgccgagcagggtctgtgctgcgtcccatgtctcacgcgcttcattcaggcggtcgttctctacgtcgagggcgaccgcctgtgccgtgttatccacggctcttacgctccatacactgccgaggatgagcacggtacacagcacggcagccgtcagcaatcgcttcatgcgcggccctcctttttctgcaggaacgtgttgccgcagtcgtcgagcgtcatcaggaacacgtcctcgaccgcgatactctggtttttcagccgccgctcgatatccgcaggggagaggtgcagcagctcgagcgagcgcggaaccatcttgccgtccgacacgacaacgagcggcagaccggtatccttgggcgtaatgccgagcatttccgccgtgaccggctgctgcggctgcttgaggataaccgtcagcgtgccgtccggctcgatgacgccgtatttcacatcggacacggctgcaacattctgcttgcggagtgtttctatcacctcgtcggtcgtcagccgcatttgccgcagcttgccaatatcgagctgtcccctgcggatgatgatggccggctgaccgttcagcagccgccggaatctgcggcttttgagtgcggcgaagctgaggaaaatctcgagcaccacgagcgtggcaatcggcaccagaccggagagcagcggaatccctaaatcctgcatgggcacagccgccagatcggataccagaatggtaacgaccagctcggacgggtccagctcgccgatctgccgtttccccatcagccgcacggcgcagatgaccgcacagtataaaatcagcgtgcgcagcagcggcactgccatacgcccgcacctccttcgcttgtgaaaatcgcacagtttgccggagtaaaaactgtacatgtttggcattgtgtagtatggcgaaaaaacaaagaaatatgcacgacagttttcgcatatttgcagtcggaaagacgttgacattctgagaaaacgcctttataatataaacaacattcaaaaagatacaggctgcgaacggaaaagtagcgtcccggacccatgatagagagctgtcggctggtgtaagacagtgggaaacggaaagtgcgaaagtcctccgggagccggattgctgaaatgaaatgaaacagggttcagtgtaagctatcccgcatgatctgcgttaaacgatcgggtgagtggtcatgccgccgtacagggcagtgtggcaaaaagagtggtaccgcagagtttttggtctttgtctctttgtgagacaagggcttttttgtttatacggtatcttgcggcaatcgttatccggctgctgcataagtatgtatgttatgttgaaatgagagaaaggaggcggattcgcaatggtaaagaacggcgcagagattctgatcgacgcacttgtagagcagggagttgataccattttcggttatcccggcggtgcggttttgaacatctatgacgcactttacaaaaacagcgaccgcattcgacatattctgaccgcgcacgaacagggcgcggcacacgcagcggacggctacgcccgtgcgaccggcaaggtaggcgtctgcctggcaacgagcggaccgggtgcgaccaacctcgtaaccggtattgctaccgcgtatatggattccatcccgatggttgccatcaccggcaacgtcggcaccagccttatcggccgtgattcctttcaggaggtttatattgccggcatcaccatgccgatcaccaagcacaatttcgttgtgcgcgatgtggaggagctggcggacaccgtgcgcgatgcgttccgcattgccgcttccggacgtccgggtccggtgctgatcgacatcccgaaggatattaccgccgctaagtgtgagtttatcccgaagggcaaggttgagatcaacgagacctacgagatttcggacgaagagctgcagaccgtagcggatatgattgccgcctctgagcgtccgatgatctattacggcggcggtgttgaaacctctgacgcaggcgacatgctgctgcagctgcagcgcaaggcggatattccgtcggcgcacaccatgatggccatcggctgcatcccggataccgagccgctcagcctcggcatgatcggcatgcacggtacggtttccgccgcatgggcggttgagcgctgtgacctgctggtctgcatcggcgcccgcttctccgaccgcgttgcgaccaacaccaagcgttttgcaccgtcggcgaaggttatccacgttgacattgacgacgcggagatcaataagaacatcggcgttgactatgccattgtttccgatgcggagaccttcctcgaaaaggttatgccgtatatcaaggaggcaaagcacgacgcatggcgcgcgcagattaccgaatggcagacaaagctcgactatgtgccgaaggacgacgagagcgttatccatccgcaccagctgctccgcacggttgcggaggagaccccggaggataccatcatcgcaaccgacgttggtcagcaccagctttggagcgcgcagtacaacggccgcaagcacgttcgtcagttcctgacgtccggcggtctgggtacgatgggcttcggctacggcgcggctctcggcgcacaggtggccttcccggacagaacggttgtccacatcacgggcgacggctcgttccacatgaaccttaacgagatctgcaccgcggtttcctataacctgtcggtgatcacgatcattatgaataaccgcgtgctcggcaacgtgcgccagtggcagaccatgttctatggcagccgctactcgcagaccgacccgcaccgcaagacagattacgtcaagctggccgacgccttcggcgcacgcggcttccgtgtttccaatatcgccgagctgcgcgacgcgctgcgggaagcgatgaagcgaaccggtcctgtgctgatcgacgcacagatcgacaaggacgagcgcgtcctgccgatgatcccggcaggcggcacggttgacgatcttgtaacggaataaggaaggagaaattatggaaaagtatatcctttctgtcaccgtacagaacaacgccggtgttctggcccgcgtatccagcctgtttggccgccgcggctacaacatcgactcgctgaccgtttcggccaccactgatccgaaggtttcctgcatgtctatcatcgtgcagggcgaccatatggtgcttgagcagatcatgaagcagctggcaaagctggaagaggtcatgcacgttgtacacctcgaagaagacagctcctgctgcagtgagctggtgttcgtcaagctgcatacgccggacgtgagcgttcgaaatgatatccggcagctgtgcgacctgtatggcgcgcgcgtggtcgatacacaggagagcgagatcatcatcgagctgtccgaagtgccgagccgcatcgatgccttcctcgacgtcatctcgaactttaagatcctcgagatgagccgttcgggtgttacggcaattgaaaaataattttggttaattaggagttagaaattgggaatgaaaagcgctgccgcgccggagaaatgtttcataaccggggagaaagcaccttgcaatcactgattactgactgctgattcatataattgactctttataaatttttaggaggaaataaaaatggtaaagatgttttatgacgcagactgcaacctgtctctgctcgacggcaagaccgttgcaatcatcggctttggttcccagggtcatgctcacgcaatgaacctgaaggactccggtgtacacgttgtagtaggtctgcgcccgggctccaagcacgagaagaaggctaaggactacggtctggaggttatgactccggctgaggctgcagcagcaggcgacatcatcatgatgctgaccccggacgagaagcaggctgacatctacaaggacgttatcgagccgaacctgaagccgggcaacgtactggctttcgctcacggcttcaacatccacttcaagcagatcgttccgccggctgacgttgacgttatcatgattgctccgaagggcccgggtcacatcgttcgccgtacatacgaagagggtcagggtgttccggatctggcttgcgtatatcaggacgcttccggcaaggctatggacatcgctctggcatacgcttgcggtatcggcggcggccgtgccggcatcatcgagtccaccttcaagaccgagaccgagaccgacctgttcggtgagcaggctgtcctctgcggcggcgtttgcgagctgatgaaggctggctttgagactctggttgaggctggctacgctccggagaacgcttacttcgagtgcgttcacgagatgaagctgatcgttgacctgatcaacgagggcggcttcgctaagatgcgttactccatctccgacaccgctgagtacggcgattaccgcaccggcaagcgcatcatcaccgaggagacccgcaaggagatgaagaagatcctgcgcgagatccaggacggtaccttcgctaccgagtggattcaggagaaccgtgcaggcggccgtgccaagttccttgctacccgtgctctggaagcagacaccgagctcgagaagaccggcaagaagctgcgcggcatgatgagctggctgaagaagtaatcttcttcgtttgaaatcatgatttcaaacgaggggatatgccgagcttcgctcggacatatcctgtgagcaaatcagcgcgtcgctgcgcggcacactgatttactcccttgtgtaaaaaccgagatacatgctcccggtttttacggattgcgatgcaatccgattgaatgcgcgccgcaggcgcgtataaaaagttaccccgaacgggcggacggattttcccgtccgcccgttttttctatcaggcagtctgctggactgctttcaaaggaggaaaatccccgtgagaagaagtgataacatcactgtaggacccgagcgcatgccgaaccgttcgctgctgcgcgcctgcggtatgaccgacgaggaaatgaatcagccgatcatcggtgtggtttcggcgtattccgagatcatcccgggccatatcaacctcgataagatcgcggatgcggttaaggcaggcgttcgcatggcaggcggtacgccggtgctcgttccggccatcggcgtatgcgacggcattgccatgggccacatcggcatgaaatattcgctggcaagccgtgagctgatcgcggacagcgtagagacgctggcacaggcgcaccagctggatggtctggtgctcatcccgaactgcgacaagatcgtgcccggtatgctgatggccgccgctcgtctgaacattccgtccattctggtttccggcggtccgatgctggcaggccatttcggcggtgaggaggtatccctgtccaagaccttcgaggcggtcggcgcttacaaggccggcatgatggacgaggcaacgttctacgaggccgagtgcaattcctgcccgggctgcggctcgtgcgcaggcatgtacaccgcaaactcgatgaactgcctgtccgaagcgatcggcatggcgctgccgggcaacggcacgactccggcggtatcggctgcgcgtatccatctggcaaagcacgccggcatgaaaatcatggagctgatcgaaaaggacatcaagccgcgcgacatcctcacgccggcagcattccgcaacgcgctgacctgcgagatggcgatcggctgctcgaccaactcggttctgcacctgttggcaatcgcaaacgaagcaggcgttccgctgcagcttgagaccctgaatgagctgtccggcaaggtgccgaatatctgtcacctcgcaccggcaggcccgcatcacattgagcagctttacatggcaggcggcgttccggccatcatgaaggagctgaccaagcgcgatttcctcgacctgtcgctcatcacctgcaccggcaagacggtcggcgagaacctcgagggcgttgtcaacaagaaccccgaggtcgttcgtccgctcgagaatccgtactcccagaccggcggcatcgctgttctgtggggcaacatcgcaaagaacggctgcgttgtcaagcgttcggctgttgcaccggaaatgatggtgcacgaaggtccggcacgcgtgttcgactgcgaggaagacgcaatttctgctatctacaacggcaagatcgtgccgggtgatgttgttgtcatccgctacgagggcccgaagggcggtccgggcatgcgcgaaatgctcaacccgacctctgcgctggccggcatgaagctggataccacggttgcgctcatcaccgacggccgtttctctggtgcgtcccgtggcgcatccatcggccatgtttcgccggaggctgcttccggcggcgagatcggtctggtgcaggaaggcgatatcatctccatcgacatcccgaacagcaaggtaaacgtcaacgtttccgacgaggagctggaggcacgccgtgccaagtacgttccacgtgagccgaatgtcaagtccggctggctgtaccgctactcgcgtctggtcacctctgcggatcagggcgctgtggttcgttgattttggcgtaatgaaaagaagtccgaaagtttttcggacttcttttttatacaataattgagaatggagaattaacgcgatggtttcatttgtgtgaatggattggacaattcatctgcatcggttatcccgcaggggcgcacagtgtgcgcccgcatcgccgttaaatgggcgtggcgaataatgttcgctccggcaatgcagtttgtgaaaattcgtttgtgcggtacaccgattgccaatcacgttcattctccatcctccattttcaattctccattccgcagccgcaaaatttctgctccaagcatagacagaactgcaccgcagtgctataataaagtaattcttaaaaaacgaaaaagggaggtcatttattatgaaaaaccctgaaaagctgcttgatctgctggcgcaggatgcccgcctgactccggcccagctggccgcaatgctcggcgaaagcgaagaggacgttgctgccgcgatcaaggcctacgagaagaattcgacgatcctcggctacaagaccgtggtcgattgggataaaacatccaaggagagcgtaaccgcgctgatcgaggtcaagatcaccccgcagaagggtatgggctttgatgagattgcccgtcagatctattcgcaccatcaggtggaaagcgtgtatctgatgagcggcggcttcgatctgactgttatcatcaagggacgcaccatgcgcgaggttgcccgttttgtctccgagcagctggcgccgatggagaacgtgctgtccactggtacgcatttcatccttaaaaaatacaaggacaacagtgtggaattcgatccggcagacagcgataagagagaggtcatggcatggtgaactacgagcagattctctctgcgcgtgtaaaagaagtgcagccttccggcattcgccgcttttttgaactggcggctaaaatgccgcacgcgatctcgctcggtgtgggcgagccggattttgaaacgccgtggcagattcgccgcgccggcattcagtctctggaaaaaggacagaccttctacacctccaactggggtcttgccgagttgcgcaatcagattgccgcgctcgtgcgccgcaagtaccgcctgtgctacgatgcggacaaggagatccttgtgacggtcggcggctccgaggcgatcgacaacaccatccgtgcgattgtcaatgtgggggacgaggtgctgattccggagccgagttttgtatgctacaagccgctgacgcagatggcgggcggtgttccggtgccgctgccgacccgcgcggaggaccagttcaagctgacggcggacagtctgcgcgccgctattacgccgcgcaccaagctgctcatcctgccgtacccgaacaacccgaccggcgcgatcatgacgcgcgatgagctgcaggcgattgcaacggtcatcaaggacacgaatattgttgtgctgtccgatgagatttacaacagcctgacctacggtccggatcgccacgtctgctttgcggagctggacggcatgaaagagcgcaccattgttgtggacggtttctccaagtcctacgcgatgaccggctggcgtctcggttgggcaatgggtccgaaggagctgatgcgccatatctgcaaaattcatcagttcggcattatgtccgcgccgacgaccgcacagtttgccggcattgaggctatccgcaccggcgaggacgacatcgagcgcatgcgcgagcagtacgacctgcgccgccgctacctgctcggcgagctgcgttccatgggtctcgagtgctttgagccgcagggcgcgttctatatgttcccttcaatcgagtccaccggactttccagtgacgaattctgcgagagactgctgcatgagcaggaggtcgcagtcattccgggcagcgccttcggcgagagcggcgaggggcatgtgcgtatctcgtattcgtactcgatgaaccatctgagagaggcttgcagcaggattcgtaagtttttgcagacgctctgaataatggaaaattgaaaatggaggatggagaatttcgttctctgaatagaaaacgcaccctgtttttacagggtgcgtttgatttagtcttttacataaccaagtgctttttcaagcgtggttgcggctttggtgtcagcatcgttaaaggacgatgaaaaggtttgcagactgccattgggagatgtaacaatattgacaatctcaagataagcatcgtatgcatcttccaaagcattgtacgcattttcccactctgccggaggactttgcaaggtgctcatatactgctgtacggtatctttactgcttttaattgaactgatatcagaggaaaaatctgaatccgaaaataggttcgccagtgcatcattaaagtcagaggcgttctgcgtgtattggtatgtttcggagtcgtatttatcccaaatggcattataccatacgtttttgataagacctccgcaggtttcagcttttgctgcgccagtatacatagccataacagcagatgagtagtttgttttataatcagcactgatttgagctgcttcggcagctgcatcagccgctttttgattcgcaatggccttcgatgctgcaattccgccgccaatgagtacgagaatgacagcaagaccgattgcaattcctttcttgccgattttagcgtagagacttttacgcggaggcgttcccggctgcagatatacggggatgggtttctcctcaacttcaaccttgaccggacatccgcaaaccggacaggtttcagcgccttcgggaatttcgttgccgcaatcttcgcaaataattttaggctgttccttcataacatgtccgcaatggatgcatttttcagccttgtccgaaatttcctttccgcattcaggacaatgaatcaatgccataatgtttttctcctttaccccaaaatacgagggcggatctacagaaatccgcccttgtaaaatttacatcttaaaatacacaatactgcttcatataagcatccatcaggggcaggagatgtgcgtattcctccttatctgcaaggtactcacggatatcctgcacggtaacgagcgcgtggaccttgatgccgaactcctcgccgacctccataacggcggtcttgtccgggttctggccgacctcacagcggtttaccgaaatgaacatatcggtaaccttcacatctgcgcagcccttgagcaccggcatggtctcgcggatagcagtgcctgcggtgattacgtcctcgatgatgataacgcggtcgccatcttgcggcttgtagccgacgatattgccgccttcgccatggtccttggcctccttgcggttgaagaagaacggcttgtcgatgccgtaattgcgggccagcgcaccggaaaccgaggtagcaagcgggatacccttgtacgccggaccgaacattgcgtcgaactgatcgccgacggtctccttgaccagagctgcgtaaaactcacccagacgggagttctgcaggccggtcttgtagttgccggtgttgacgaaatacggggtctttcgaccggatttggttgtaaaatcgccgaagcgcagtacgtcggcactcatcataaattcgataaattcctttttagcagcagtaagcatgatcgttccacctttttctatcaatatacttatcctcagtataccagaattttcggcagggaacaaccctttctgtcaagccgtatctgcaaaattacacaaatacacagctgaatttacggcttctgaacataaatcaccaaaaagcctgttgcggaaagcgcacaaacgaggtaaaatatactcaggcaatactgccgatatggcgattcggaatcgtcaatcctacaaaggtggctaacaacacaaatggcatttcacggtttttccgcagaaggcgtggatcttctgcaactgaatcgtctgcaaaacagcaaagaattttacgatgcacacaaggacgagatcaagcggttatccatccggccctttcacgaactgatcgcggaaatgacgccggagatggtcaagatcgacccgcagttcgtcaccgtgccgtcccgcatggtatcccgcgtgcggcgcgatacccgatataccaaggataaaacgctctaccgggcgaacatgtggctgttcttccgcagagcacgacgggaacgcgaatccgttcccgcatactactttgaactgcatcccgaatactgggccttcggctgctggggcgcgtggggcagaggcgaaatggaagcgctgcgcgaaatgatcctcgcagaagacaggctgttccttgacgcctttcgtgcggtgaacagctgtccgcaggtgcacctcgcgggcgagatgtacaagcgcccgaaattcccggacgcaaagccggaatatcaggactggctgaaccgcaaggagatcggcgtggactacacgaacggtgaggattttactccggtgctggacggcacgtttgttccgttcatgctgaagaccatgcggcagcttgcgccgctgtacagactgctgctcgcggcgaaggaacgcgcagacgcggccggacgggaggcgctgcaatgagatatcttgcactggatttcgagactggaaacgcctcgccgctgagcgcgtgcgcactcggcgcaagcgtgtttgaggataatcagctggtggatgagaaaatctcgctcatccgtccgccggaatgcgtgggcaggttccactggggcaatgtccgcgtcaaccacatcaaggagaagatggtcgcggacgcaccgtcgttcgccgaggtgtgggagccgctcgccgacatcgcggagggcagcgtcatcgtgtgccacaacgctatgttcgatacgaatgtgctttgcagctgtctggcgcattacggactgaaaatgcccgaatgccggtacttatgcacggtaaaggtgtccaagcgggtatggcctgagctggaaaatcataaactggatacggtatccgctgcgctgcacatcgacctgaaccaccacgaggcggggtcggatgcgcgggctgcgggactgatcctgcaggcggctctgcgcaggacgggcagcgcggacgccgacgcactggcagaaaaaatcggcatgcggctcggccggatttcctcgatggggaaaacgccgtgcagcatcgccggggaccccaaacccagggagcacagacggacagcacgtccgcgtaatacggtaaaacgaaaaggagagaacaaggtatgaaaaactatctggacagtatcgaccgcgctgcactgcgcagccgtgccgagcagatgctgcacaccgcaggcgacgcctgtgatcaggcagggcgctttatgaacaccacgaccgaaaagatccgcggcttctcgctcatcgagttcttcatctacgagacctgcctgctgtcgttcggtctgtggctgggcacctgcttctctaaattcttcaagaagttccgcgcgatcatcttcgcagcgtttgccgcaacgtggctgtacctgctgtggcgcgtgttctttgatgaggatgaggactgagcgtattcaatcttcgttttcatcctttgacagctgacaggaaggagtttattgttggaagatcccaatcaggaaaaaaagtcccggtttgacctgcagccgcactatatcgagtggggactgactgcgttaggtgtcattgtagcctgcgtgctggtcgtgttcgtgctgttccgcatgacaatgatctggggcataatcaagaagtttttcagcatcctcagcccgttcgtttacggctttgtgatggcgtacctgcttatgccggtgttcaacatgctgtaccgcaatctgcagccgccgatgtcgcgtaaattcaaaaacggcacacggcttgccaagggtttgtgcagtgcgctgacgctggccttcggtctggcggttgtaggcgtgctgctgtggatggtgctgccgcagctggtcacgagtatcacctcgctggtggattcgatggacctgtatatgaacgagatatccggctgggtagcatcgctgctgcacaacaacccggaacttgagcacagcttcatgcgcctgtacgatcagttctctgcacagatgatgaactgggcgcaaaatgacctgctgccgcagctcggcagcatgatgagcggcgttgttacgaccgtaaatgtgctgatgaacctgctgatcggtgtcattatcgcgctgtacattctcaacagcaaggacaccttctgtgcacaggcgaaaaagatgacgtacagccttttcgcggttgaaaaggcgaatgccatcatggcccgtgtggcgcatatccaccgcgtgttcggcggcttcatcaccggcaagctgatggactcgtcgatcatcggcgtgctgtgctttatcggtatgcgtcttatgatctcgttcggctggatgaccatgccgacgtcgtacgcgctcctgattgcggttatcatcggcgtgaccaatatcatcccgtttttcgggccgttcatcggtgcgattccgagcaccattctgatcatggtcatcagtccggtgcaggcgctgtatttcgtcatttttgtgttgctgctgcagcagtttgacggcaatatcctcggaccgaaaatcctcggcaacgccaccggactgtcgagcttctgggtcatgttcgccattctgctgttcggcggcgtgatgggcttcgcaggcatggtgatcggcgtgccgctgtttgccgtgctgtacagcatgttgaccgagaagatcaatcatctgctgaaaaagcgcggtctgtccgtggatacgaacgactatcgcgggcataagcgcatcgacccggagacacacgcgttcgttgaagcgcaggagacaatgcctcctgtgagcgcaaaagagcgtcgccgtgcggcacagcagaaagatcaggaaaacaaaaaccagtaatgtgtgcaaagagggacactgcgagttagcggtgttcctcttttgcgttctgatgcagaacggcagagtgtcgcttgagaagcgaacggaactgcgctgacgccgcgcgggcgcacaagagggtagacacctgcgctgacgccgcgcgggcgcacaagagggtagacacctacggtttccaccctcttgtgaatcacccctttcccttggagagtctggcgcagattaccgagatgtgaccgctgcgaaataggggaacggcagaggattttttcttccgtgtcttcctcaacctgttcgcagggttagataccattctgctacacaggcggttttgtctccgcaggcgcaacatacccgtgttgcgcaattcgtgagcgcgttatgatagacagcacctacgaggataaattgtaccaaatgcctaatccgcaggtgccgtccgttacaacgcgccaaagagttgcgcgacactgttatgtcgcgcctgcgtagatgaacccacatgtgtagcagtaatttatctgacgctgcgaatatttcacgaaagacacgctgcggtaacccgactgccgttcctttatttcgaagcggtcacatgtcggcaatctgcgccagattaggaagcaagggaaaggtaggagttcaaagaggaagggaaaccgcaggtgtcccttcctttttgccccggccgcgggcgcggcgaatccccgcgctccgcagagcgcaactcctcgcttgatttcaagcgaaaaacctcccgcccgttagggacgaacacgctaacgcagttcgcgcaccccgctcagccggtgcagagaaaaaggctgccgcccgttaggggcgaacacgctaacgcagttcgcgcaccccgctcagccggtgcagagaaaaaggctgccgcccgttaggggcgaaccgcttatgcggttcgtgtaccccgctcagccggtgccgtatagagaaaaaaccgatttttaaccgaaaaaatctgcggaaacccgctcggactgattgcgcatcccatctacatttgttataataaacagtaaagcaaaaaccaaaacggcacggcaggacaaatcggagcctgctcccggtgccggaccttcgatgcgccgccgcatgacgcggcaggaattccgagggtataccacttaaactttttatatagatttttggaggattaaacgccttatggagcatattaaggattgtatcgcggcactgcgagaggccgcacctgaaatagatattgcagaaaacgaactcatgcgccgccataccacgttcgccatcggcggaccggccgacttgttcgtgcagccgaagacccgcagggaactgaccgcggcacttgccgtactgcgcgagcgcaatattccgttcctgctgctcggcaacggctccaacatgctggtggccgatgcgggcatccgcggtgcggttgtctgcacatccgagctggatgaagtccgcgtaaacgaggataacaccgtctctgccgaggcgggcgcgctgctcagccgcattgcccgccgcgcacagcgttccggtctgaccggagccgagttcgccggcggcattccgggcagtctgggcggcgctgtttacatgaatgcgggtgcgtatgacggcacaatggccggcattgtgcaggagaccgagttcgtggacggcgaaggcaacatttgtacactcaagggcgatgagcacggcttcgactaccgcacgagcgtgttccgcaagcatccggactggacggtgctccgttcgaccatgcagctgcagaacggcgattcggcggcgattctggataagatgaacgatttcgcgcagcgcagacgcgacaaacagccgctcaacttcccgtcggcaggctcgacctttaagcgtcctgtgggacactttgcgggccagcttatcgagcaggccggtctcaagggcacgagcgtcggcgcggcacaggtttcggaaaaacacgcgggatttctcatcaaccgcggcggtgcaacatgcgatgacatgctgcgtctgatcgaactggtgcagaacagggtgcgcgagcagttcggcgtggagctggagtgcgaggtgcgcatcgtaaaataatcagcagcgccgctcggcggcgttatcacagcagaaccacagggcagggggaaaggtaacatgtattttttgatcgtttccggtatgtcgggcgcaggcaagagccgcgcggtcgccacgcttgaggacttaggctattactgcgtcgataatctgccgatctccctcataccgcgcttcgcggagatctgtctggcggcaaccgaacgctatgaacgtgtggcgctcgtcaccgatgtgcgtgcaggcggcgattttcagcagctgtttgattcgctggattcgatcaagagcatgggctgcgattaccgcatcctgtttctcaacacggacacgccgacgctcatccgccgctacaaggaaacgcgccgtaagcatccgctgatggaaaagggcatgtccatgacagccgccatcgaaaaggaacgcgaaatgctgtccggtctgcgcgaccgtgccgactttgtggtggacaccaccggactgtctgccgccggtctgcgcgagcgtctgctgacgctgttttccggcaccgagagtggcgaggtgttcgaggtcatcgtgcagtcgttcggcttcaagtacggcattccgcccgagagcgaccttgtgttcgatgtgcgtttcctgcccaatccctattacgaaatgagcctgcgcgagcgcaacggcaccgatccggaggtgcgcgattatgtgttccgcggcggtacggcggatgtgctgatgcgctacctgacgggcatgatcgactttctgctgccgcgctatatcgcggaaggcaaggcgaatctgatcatcagcatcggctgcaccggcggcaagcaccgctcggtcgctatcaccgaggcgctgagcgaacacctgcgcaggaaggaatacggtgtagtaaccatgcaccgtgattaccagagataaacccgcttcgttccggacaggcgaagcgtgctgtacagaacggagagaatatatgtctttttcaaccgaggtcaaaaacgagctgtgccgggtatccatgcagcgcgcctgctgcacgcgtgccgaggtttacggcgcactgctccatgcctcggttttttcgcacaaggagatacggctgtcggcggagaacatgaccgttgtccgtcgcctgcaggcgctgctgcagcgcgcgttttttgtcgagtgcgagccgcagaaggcaggccgcaagcagcagcttgtgctcaccgaaccggcgcagatcggacgcgtgtttgatgcactcggctacgactgcaagagccatatcacctatcatatcaaccgcaatctgctcgaggaggactgctgcattgcgtcctttctgcgcggcgccttcctcatgggcggcacggtcgcgggaccggacaagaaaagccatctcgagctgaaaaccacccaccagagtctgtcgggtgaggagacaagcctgatgcttgatttaggtttatcgcccaagcaggcacggcgcggcagcgcgtatctgctgtactttaaggacggcgcaagcgcggaggatttccttacgcgcatcggtgcgccgcacgcggcgatggagctgatgcaggcgaaggtggagaagaatctgcgcaacacgatcaaccggcaggtcaactgcgagaccgcgaacatgatgaaggccgccgatgcatcggcgcggcagatcgcggcgattcaggcgctgatcgacagccggggggaggacgcatttccgggcaacctgtgggagaccgtgcgcctgcgtctggaatacccgacggacagcctgtccgagctggcgcagcggttcgacccgcccatctccaaaccgggactgagccaccgcctgaaaaagatcatcgagcttgcggaaaaggaggactaaattggtaccatttgcacatctgcatgtccacagcgaatacagcctgctggacggcgcctgccgtatcgaaaaactggtggaccgtgtggcagagctggggcagacctcttgcgcgctgaccgaccatggcgtcatgtacggcgtgatcgacttttaccgcgcctgcaaggcgaagggtatccatccggtcatcggctgcgaggtgtatctggcgccgcattcgcgctttgaccgcagctacatcaacggcgagtggcacacgcacctcatcctgctgtgcgagaacatgaccggctaccgcaacctcatccacatggtgtcgtgcggcttctctgagggcttctatatgaagccgcgtatcgacatggagctgctgcgcgcgcacagcgaaggtctgatttgtctgtctgcgtgtctggcgggcgcgattccgcgtgcgctggcggacggcgatatggacggcgcgtatgacctctgcgagcagtttctcgatatttttgaccgggagcatttctaccttgaaattcaggaccacggcattccgctgcagcagaaagtcaatgaaggtctgtaccagctttccagggagctgaacatcggtctggtggcgaccaatgacgcgcattatctgaccaaggcggatgcgcgcattcaggacgtgctgatgtccattcagatgggcaagaccgtggatgacccgacccgcatgaagttcgagacgcaggagttctacatcaaggatgcggacgaaatggcggcgctgttcccggagcacccggaggcactcgccaacacggtaaagatcgcagaacgctgtcaggtcgagttcgagtttggaaagtaccatctgcccgaattcgatgtgccggacggctacacctcgctcgaatatctgcagaagctgtgcgatgaaggcttcgcaagacgctatccgaacgatgacggcaccgtgcgcaagcgtctgcagtacgagatcgacatgatcgccaagatgggctttgtcgattacttcctcatcgtgtccgactttatcggctacgcgaaaagtcagggcattccggtcggacccggacgcggctcggcagcaggctcaatcgtgtcgtactgcctcgctatcactgaccttgatccgattcactactcgctgtacttcgagcgatttttgaatccggagcgtgtctccatgccggatatcgacgtggacttctgctatgttcgccgtccggaggtcatcgagtacgttacccgcaagtacggcaaggaccgcgtggcgcagattgtcacattcggcacgatggctgcccgcggtgccatccgcgatgtcggccgtgcgctcaacattccgtacaacgatgttgacgcggttgccaagcaggtgccgaacgagctgcacattacgatcgacaaggcgctgaccatcaacgcggagctgaaaaagatgtacgacgagcagccgcaggtcaaagagcttattgatacggcgcgtgcgctcgagggcatgccgcgcaacgcatcgacgcatgcggcaggtgtggttatcaccaaggaccccgtggacacctacgttccgctgtcgcgcaacggcgaccagatggtaacgcagtttacgatggtgacgatcgaggagctgggtctgctcaagatggacttcctcggcctgcgcaacctgaccgttatcgcggacgcggaaaagctgattcgccgtcacacgccggatttttccatcgagaacgtggatatgagcgaccccgcgacctatgaaatgctcggcaagggctcgaccatgggcgtgttccagcttgaatcggcgggcatcaccaatgttgttaccggcctgcggccgcagtccatcgaggatattaccgcagtcgttgcgctgtaccgccccggtccgatgcagtccattccgcgctacatcgagtgccgtcatcatccggaaaaggtaacgtacaagcatccgctgcttgagccgattttaagcgtcacctacggctgtatgatctatcaggaacaggttatgcaggtgttccagagccttgcgggttactcgctcggcaaggcagatatggtgcgccgcgccatgagtaaaaagaagatgaaggagctggaaaaggagcgcgtcaacttcatctacggcaatgaggagctgggcattgacggcgccatcaagcgcggcgtgcccgaagctgttgcggcaagtctgtttgacgagatcatggatttcgcaaactacgcgttcaacaaggcacatgcggtctgctacgcagtcgtatcgttccgcacggcgtatctcaagtgccattacccgagagaatatctggcggcgctgctgacaagcgttctggatgtttcggataagatctccgagtatattcaggcggcgcgtgatatgggtatcgcggtgctcccgccggacgtaaacgagtcctatgacgagttttcggttgcgggcgagaatatccgcttcggtctggcagccgtcaagggtgtgggacgctcgtttatgaagcagcttgttgaggagcgggaagcgaacggcctgtttacctcgttccaggatttctgcgagcgcatgtatgaccgcgaactcaaccgcagagcgctcgaaagtctcatcaaggcgggttcgttcgattccatgcactactaccgcagtcagcttttgaaaatcgtcaatcccgtggtagatgccattgcccagaaccgcaagaagaacatcgagggtcagatggacctgttcggcatgggcaacgacgaggtgcgcgacacgcagattgcgatgccgaacattccggaagtgcccaagcgggagctgctggcgatggagaaggagaccaccggtctgtacctctccggtcacccgatggacgagtaccgcagcctgacgcagaaggcgcaggcggcttccgtcaagcagatcatcgacgacctgacgggcgagagcagcaggccggtctacaaggacggcatgaccgtccggcttgcgtgtgtcatcacggcggtgcgtctgaaatcgaccaggaacggctcgatgatggcgtatgtcaccgcggaggacgacacggcggcgattgagcttgtcgtgttcccgcgttcgctgcagcagtgcggcgcatatctcaccgaggacagcgcagtcctgcttaccggtaagatcgacgcacgagaggacgaggcgcccaaggtgctgctgaacgaggcgcagccgctcaccgagagtgcagtggagagcctgcagcagccgaaaaagggcacacagaagtcggtctacaccgatgtgcaggcggcaaagctggcgccgcaaaagctgttcctgcgtatttccagcctgcagagtgatgaatggacgcagattaaagaggttttgcgcacgcagcccggcgatacgccggtctatctctatccgatggacacgaagaaaaagacgctcgctgcccgccggtactggtgcaaaccggatattgcatttttaacaaaattacgctttctcttgcgcgaggaagatgttataatacaataggaaactgtgcttatccttggggagagacggtttccgcagagggaaacagaactgcaatacagcggtcagtgcggcatcgaccgtgccgccaagaaagaaaacagaaccgacaacagggaggctttatcatggataaacaaattcgcagaatcggcgtacttaccagcggcggcgacgcacccggcatgaacgcacttattcgctcggtagtccgcagcgcaagcgcaaacgatatttccgttctcggcattcgccgcggttacagcggtcttatcaacggcgatatcatcgagatgggtgcccgcagtgtagacggcattatccgcaagggcggcaccatgctgtacaccgcacgctgcaaggaaatgctgaccgaggaaggtctgcagaaggcggctgacacctgccgctacctcggcattgacggcctgatctgctgcggcggcgacggtacattccgcggtgcacaggcgctttcccgcaagggtgttccgtgcatcggcgttccgggtaccattgataatgatatcggctgctcggattacaccatcggttttgacaccgcctgcaatacggcgatcgagtgcatcgataagctgcgcgacaccatgcagtcccacgagcgctgctctgttgtagaggttatgggccgccgtgcaggtcatctggcactgcaggttggctgtgcagtcggcgcgaccgcgatctgcctgcccgagcgtcagctggatttcgacaccgagatcgtagagagaatgcgcatcggccgtatcaagggccgcaaccaccatatcatcatcgtagcagagggctacggctctgcacaggaggtcgcagaccagatccacgaggctaccggcatcgatacccgtgttaccatcctcggtcacatccagcgcggcggctctccgtctgctatggatcgtgttatggcgacccgcatgggctacgctgcagttcgtgctctgatggagggcaagaccaaccgcgttgttgtttcggataacaacattgttaccgatatcgacattgaggagggtctggcacagagcaaggatctgaaccagtgcctgttcgaggcacagcagacggttgccatctgacatggcgcagactgttctcatcaccggaggctcgcgcggaatcggtgccgcctgtgtgcgcacgtttgccgaaaacggatggaataccgcgtttacttacagcaaaagcagggaagcggcggacaggctcgctggggagaccggcgcgctggcacttttggccgatcagcaggataccgcggcagtggaacttgcggtcgcggaaggaaaggcgcggttcggcacgatcgatgccgtggtctgcaatgcaggcatcgccgaccagaagctgttccagaatatcaccgacgcggactggatgcgcatgctggatgtcaatcttatgggtacggtgcgcacgattcgcgccgtgctgcctgaaatgctgcacaaccacaagggaagcatcgttacggtgtcgtccatgtggggggagtgcggcgcgtcctgcgagagccattattccgcgagcaaggctgcgattatcggcctgagcaagtcgctcgcgcaggagcttggcccgagcaatatccgggtcaactgcattgcgccgggcgtgatcgacaccgacatgaacgccatgcacagtgcggataccatgcaggagcttgccgatcagacaccgctcggaagagtcggcgcggcagccgaggtcgcggacagcattctgtatctgtgctcggataagtcgtctttcattaccggacaggttttaggcgtcaccggaggattttaagatgctgtcgccaaaccacggtttggccgacaagaggaacggaccgtgggccgttccaaagtcgtccgaaagttcccatacggaaactttctccctcccaaagtcaaaaaatcctgcgctatccttgcgcggcttctcggccgcgctgcgccgatacatgctcccgcttttttggaatttgcactgcaaattctattaaatgcgcgctaacgcgcgaaaagctgcgacgttagtaaagttcgttaagaaagatagaacgagaggtcaaaagacctctcgttttttgtttaatacggttccaagtcaaaataactgagcagaccgttataaatgccctgtgcaaacccgaacggatcgttctccagcttcatcgcatcggaagcattggtcaggtatgccagctcgaccagaatcgaaggcatctgtgtccgccgcaggacatacaggctcggacggatgcgcacgccgttatcgcgtgtgccgacacgcgcaacaatgccggcgagcacatgctgcgccagccagtacgcctgcgtattttcctgataaacatacacctcagtgccgttgacggcgggatttacgttcgcgttgcagtggatactgatgaagtaatccgcaggccactcattcgccagccgcacgcgctcggccagactggtggcattgcttgtgccgaggatttcctcgggtgaggtgcggctgagccgcacctcaaaccgcgggtctgcccgcagaagatcagccagatacacgccgacagcgtaggtcacatcctgttcgagcagaccgccgccttctgcgccggtgttcggaccggacggattgtgtccctgatcgacaaaaatcttgatcgccaaagtatcacctcctcgtgtcagcctatgcggcagcgcggcagaacgtccgtgcttgacggtcagcacacgccgtgctattctgtaagaaaagagaggtgggatcaatatgaaattatatatcaaacaaaaggtattctcctgggtggatcggtttaccgtttttgatgaaaccggcgccgacaaataccatgtcgaaggggagttcttctcgtggggcaagaagctgtatgtcaccgacttgaccggacacgagaccgcgtttatccagcagaaggtgttcagtatgatgccgcggttcttcgtgtacatcgacggcgtggaacgcgcggaaatcgtcaagcggcttacatttttctacgaaaaatacgagatcgagggtctcgactggacgatcgagggtgatttctgggcgcatgaataccgtatcacgcagaatggccgcgaggtcgtgtccatctccaaggagtggttcacatggggcgactgctacgcgctggacatcgcagattcggcggatgagatgcttgcgctggcggtcgtcctcgcaatcgacgcagtgcacgcgcaggcgaacgcggcagcggcttcgacttgaaaggaaacgatatgattgagataaaccaggacttcgcggacggtgtactgcattcgcgcaatccggagacaaataaaaacgactacggccgcattctgtgcgtgtgcggctcggcgggatatacaggcgcggcgtatttctccgcgcagggcgcggtacgcatgggaagcggcgttgtgacgcttgcagttccgcagggtgcgtggccggtgctggcggtcaagctgaatgagccggtcgtgcggcccatgccgcaggatgaaaacgggctgttttccatggacgcactgccgaagctgcttgcgcttgccgaaaaggcggacgcgctgctcatcgggtgcggactcggccgttcggatacgctgaccgaaatcgtgtgtaccctgcttgaaaaagctgcttgccagattgtgctcgatgcggacggcataaattcgattaccgggcataaggatatattgcggcgaacggcaaagccggttgtgctcacgccgcacgcaggcgagtttgcacggctcagcggcaagccggatgcgaccgctgcggacgcggcacagttcgcgcaggactatcggtgcatcgtgctctacaagggacaccgcacccgcattttcacgccgaacggcggcggctatcgcaatacctcgggcaatcccggcatggcgaaaggcggcagcggggatgttctggcaggcatgctggtttcgctgtgcggacagggcattgacgcagttccggcagcctgtacggcggcgtggctgcacggcagagccggagatctggctgcgaatgcgctgagcgaatacggcatgacaccgagcgatatgctgacgcagctgccgattctgctgaaacgatataactcgaaaacatggtgataaaccggtcaaaggagtggtaatctgaacaggctgctgtgtggtttggcgacgcttgttctgctctgcggctgcggccgctcggcggaaatgagtgccgaggatgtgcgtgcgcatttcgcatcgttggacagctgtacggcgcatttgaaaataatctcggatttggacgaatctgtactggaatttgaaagcgactatgtctataatagagaggacagcgattctttcacgctgaccgcaccggagtcggtcgccggtatcggcgggcgcatctcgggtgaggagaacggcgcgttcacgctgcagtacaatgagctgcagctggatgatattgctcctcggcacaccggactgaccccggcagacgcgtggttctgtctgctgaacgatctgcggtacgctgcgcctgcacaggtgtggagcgagcacacaaacggcgagagcctgctcgtgctgcgctatgaaaatgcagacgacagcgtggaaaagcaggtgtggctgcggcagagcgatctgcagccggtctatgccgagctgtatgcggacggtgcgcgcgtgctgaccatacaggtggaatcctgtcagtaaatcaggaaccaaacggttctgttggagtgacgaaaacaatggaagtaaatcaacaccgcacttgggcggagatcgacctcggtgcgatcgagcataattatcgcgtgatttgcgagcaggcacaggcgccggtcctgtgtgtcgttaaggcggacgcatacggtcacggtgccgtgcaggtggctaagcggctggagaagatggacgcaccgtattttgcggtagcgaccattccggagggtgtggagctgcgcgaagcaggcatcgaaacgcccatcctcatccttggctatgtggacgagaaggatatggacacggcggcacagtacggcatcaccgtgccggtgtacgaccgcgagaccgcagaactcatcagcgcggcagcagagcgcaccggcaagccggtcaccgtacactacaagctggataccggcatgacgcggctcggcttcccgtcgtgggagtgtgagcagaccgtgcaggatatccttgcgtgctccaagctgccgggcctgatcagcgaaggcattttcacgcattttgcggttgccgacgtgccctccggcgaggcgtacacggaattgcagtacaagcgcttctcggatgtgtgcgagggtctgcaagcggccggtcttgacctgccgctgcgccactgtgcgaacagcggcgccatccagacctacgagaagatgcactgcacgatgacccgcgcgggcattatcctgtacggctatcggccggatgcctccgtgccgccggtgctcgatctgagacccgccatgaccgtcaaggcgcgtgtggtgcaggtgcgcgatattccggcgaatacgaccatcagctatggacgcaccttcgagacggcagagccgacccatatggcggttatctcaatgggttatgcggacggctatctgcgtaccggctcgggcaaggcgcaggtgctgctcggcggcgtgaaagcgcctgtgctcggccgcatctgcatggatatgtgcatggtgcgtattccggagggcgtagacgtacatcgcggtgacgaagtgaccgtgttcggcccggaaggctggacggcagaggacgcagcagacgcggcgggcaccatctcgtacgaggtgctgtgcgccatcagtcagcgcgtgccgcgtttctatcggtaatttactgacattgcgtgcataagatgaagcgagggattttccctcgcttcatttgtctctcaaagtcggtatcctgttagtttgatagtatcgcgcggcagcgctattaaaacagcatttgcgttgcaaatgcaagaaaaccgggagcatgtatcacggttttcttacttctggagggagaaagtttctgaacaggaactttcggacgactttggaacggcctgcggtccgttcctgcttgtcggcgaaactgtagtttcgcgacagctttgaagcggaggagatttttctctctccgcttttctgcattatacagttataattttgtgtgacacggggaaaatagatttgcgggaaaaccatcaggcagcaccgtaaatctatttcatcggagtgtgaaccaaagtggatagcaacatcaaacgaggcgatatttactatgccgatctcagtccggtggttggcagtgaacagggcggcatccgtccggtgctgatcgtgcagaacaacgtcggcaatcggtacagtccgaccgtgatcgccgccgctattacatcgcagatcaacaaggcgaaaatgccgacgcatatcacggtcggtgcgccgaactacggactgaccaaggattccatcatcctgaccgagcagatccgcacgctggacaaacgccgcctgcgcgagaaaatgggctcgctcgacgaaaaagccatgcggcacgtcgatgaagcactggcagtcagcttcggactcggctcggtgcaggggtaagccgtataacggcgggagaaagcgcatatccttttatagggtatgcgctttttgcgtatagactgggatttgccgtctgcggacggcaggaacgtgccgcgcccgcggctggggcaagagggtagacaccaaggtttgcccgtaggccactaaaccttgttcccgcgccgtgcgcggattaaatgagtactaccctcttaactcccgtttccctttgtttcttagcttgacgcagaccagagaccggcgaccgcttcgaaaaggggaatggcagtcggcctacccttacacgctgacaagggtctcttctgcgtcagacagcgcgtgccacaccgtaatcgcaggcgtaatctttgggcggcatagccgtgccgccctctgcgcaggctttccgatatgtgtagctgtacgctatctatgaactgcgcatattttgcgaaagaaacgctgcggtaacccgactgccgttccccttttcgaagcggtcacatataggaaatctgcgtcggactctctaagggaaaaggggagattcataagagggtacgtactcattaaatccgcgcacggcgcgggaaaaaggtttagtggcctacgggcaaaaccgcaggttgtctaccctcttatgcgccccgccgcgcaggcgagtttcgctcgcttcgtaagcggcaatttaacaaattataacttgcagaaaggagaaccgcccatgcgcgcagacgtattctgtaacgacaacccaatcggtacgatcgactggatgccggatgcctgcggcgtgcaggtcaatctcgactgcgccgtctgcggggatgaactgctgcgctgctatgcggttgtgaacggaaacatcctgcgggtcggtctgcctgcaccggagcatggccgtctgcgcctgcgccggcatctctcgcggcaaatgctgcatgagactggctgtgagggcgaacccgaacggttctatctcgcgtctgcgccggagcctttgccgcagagcaatgcgccgcccgagccgtcgcttgtcaccggagatacggtcttggacgcgcttctatccaacgaaaacgtgcagattcagccgaccgagaccggactgcgtctgcaatgtccgttcgacccgaaaaagccgttcgcgctggcgcccgcctttgtgctttgccgcacagaaggaaacacggcagttctggaatggaaaaaggacgcagccgatgcggctgcgtcctctgaaaaggcgtaactttaggtaataccgcataattgaacaagagtgatttgcgagtaaattttgcgtactgacgaggcacagttttgcggtaatacttgatgtattaccgtgaaacctcggcagcgcggacggaactcgcgcaaggaaccgaagccaaagtcaggacacaaaatttccgcaaagcaccgcggcagtgcgaccggagcctgcacaaggagccgccgctttaattgtgcggtgttgccttttactttacgatggtctttgcctccatgtagtagcgcttctcgtgcgcctcacccatggagaaggtcttgcgcggcagaacgccgtcgaaaacaacgccgcggaacaggtcgttcttggcgatgtccggcaggatgaagccgaggttgcccggcttttccgccagcgaaacaacaacgtccgtgccgtggatgtagtcgatcttcgcggaggtgtgggtctcaagataagcgtccagaccggtctggatggtagcgaccggaatggcccacttcgggttctcgacaacgaacacgcccgacttgttcgccgagcagaacgggaagaagtgcgcggtatcactcttgggagcctcgtcggcaacgtaagccttgcagccctcgccgttgtagaagtcggtcagtgcgccgagcagctcatcggcgtctacgccgaacagggcacggtggatcggctcgatgatcaggctttcgtcatggatgttgacaacctcaacgagtgcaaaacgtgccggatggttctcctgctcctcagcagtcaggcccttcttgacctcttcccagtacgcctttgcggtggccatggagtggttgccgtcgcctactgcatacggcagcagcgcctgtgcgtccgtgcagccgtacttcttgttgaaggtctcgcggtcgcagagtgcttcgagcttggcctcgatggcttcggtctccggaccgttcggcaggaaccagccggtgatatggccgccgttctgcatcaggtcggtatcgtacagcttgtcataggaggcggtctgctcgaacagcggctcgatgatctgacggtcgggatcgtcgatcaggatcatgatgtgcggcagctccaggcatgcgccctgacgaaccttgagacggggcggaatacgctcgacaaccgtcttttcggtcgggcggatgagcgatgcggaaccgggcgtgtattcatacgcttccagatcgactgacagcacgatgccgcggcgcgggcaggagccgccggaccagcgctcggtcagcacgacgccagcgggcagggtgcgcagcgtgccgtcctgcacatactgctgcatggtctgatggattttctccgtgcgggcagcaacgtccgcgtcctccagataaacctccggcagggtcagacgcagggtagagggtgcgtcaccgacggtcttgtcagtctcggcccagtagtccggctgagaggtgtactggtcgcaggcgataactgcccacttggacaggtccacgccttcacgcggaaacatgatctcgggaatacgagtgcagcgattagccataattatccttcctccagtagaagtagtgtggaatgcctctattatagcagacaaatcctgagtacggcactcgtttttcaaaaataaatgtcggtttgcagaaaaaactttatttgcttgacgaaagtatggggatgttgtacaatataatataggtttggttgcgaaatttgtataaaaatacaatcgtaaaaacggaggaaaaccccatggttaaattcaaggctatcggcgtttcggagggtctggcgaaggcaaaggctctcgttatcaaggaagaagatctttcggtcgttaaggagaccgttgccgatgcggaagccgaatgcaagcgcgttcttgacgcagtggaaaaagccaagcagcagattgaagtgctgcgtgacgatgcggaaaagaatatcggtgcggctgaggcggaaatttttgacgcacatctgatgatgctcgacgaccctgattttgtcgagggcatgacaaacattgtaacggatgagaaggtttgcgcggagtacgcgtgctttgtcaactgcgagaactttcaggcgatgttccgcgcactcgacgacgaatatatgcaggcgcgtgcagcagacatcggtgatatttctcagcgggtcattaagaatctgaagggcattgcggataacgcgatcgacacgatcaccgagccgtgcattattgtggcgaacgaccttaccccgtccgacacggcgaagatcggcggcaagccggttgccggttttatcacgaagatcggcggccgcacgagccattcggcgatcatggcgcgttcgatgggtattccggcgattgtcggtgccggcgagaaggcggacgagatcgcggacggcgacctgctgctgatcgacggcgcggcaggtgaagtagtcgcgcagccggatgagcagacgcttgccgactttgcggagcgccagaaggccgatgcggcgcatcgtgccatgctcgcgcagtacaaggataaggagggcgcgacctcggacggccgccgtgtaattatcgagggcaacatcggtacgccggatgacgcagtccgcgtagcggagcttggcggtgaaggcgtcggcctgttccgctcggagttcctgttcatggatcgtaccgacctgccgagcgaggaagagcagttcgccgcctacaagaaggcgtgtgagatcatgcagggcaagccggttatcatccgcacgctggacatcggcggcgacaaggaagtgcccgcactggcgctggagaaggaacagaatccgttcctcggctaccgcgcgatccgcatttgcttgaatcagccggagctgttcctgattcagcttcgcgcgctgctgcgtgccgcgcagtacggcgatctgcgcattatgttcccgatgatttcgtcggtggatgaggtgcgtggtgcaaagcaggtgctcgagcaggcgaaggacatgctgaccgcggaaggcgtacccttcaatccgaacgtcaaggtcggtattatggtcgagattccggtggcggctgtctgcgcggatgtgctggcgaaggaggttgacttcttctcgatcggcacgaatgacctgattcagtattcctgcgcggtggaccgcatcaacgagaagatttcctacctgtaccgtccgctgcatccgggcgtgctgcgcctgatcgccatgacggccaaagcagcgaacgagaacggtatcgaagtcggcgtgtgcggcgagatggcaggcacggccggcatggcgccggtgctgtgcggtctcggcgtgaccaatctgtccatgtcggcatccgcaatgctggcagcaaaggcagaccttgcaaagcactcctgcggcgaatgcaaggagctggctgacaagctgctcgcgtgcgcaagcgcgtctgacgcagagcgtattttcgcggactggagagagtcctgagtaagagtaaaaagccgccgtttccctgtgaagcggcggctttgcactgttcggatggatagaaattgacttgtatcggaaaatggatatcgtttatcaggataacaagcattatctgagcaaatccatgtcgtttttctcgcccagtgcggcggcctgcttcgttttgggcgcaagcgcgaacggctggacggaatggaaggataagagcggcagaacactcgatgagctgttccgcagacaggcagagaaagcataagtaaagggacacggaatgattctgtgtcccctttttcgcaggaaagagaagcgtttagccctggcttgccatattctgctcgtaggattcgatcatcttctttaccatctgaccgcctacggagccggcctgacggctggtcagatcgccgttatagccctgcttgaggtttacgccgacctcggcagctgcctccattttgaagcgatccattgccgcgcgtgcttccggtaccatgccctgattagaaccatttttcgtgttagtcatgtttgttcgctccttttcgattcggtttagtgtgttgggttttgctgatagtaggttgcgcaccaaaggtcgaaatatgagatgcaaatgctgtgacggaagccagaaaatatgataagcaaacgcgttttgccagcgcaggaaaacaagcgttgaaaatttgcttttggacagcgcataaaacctgctctgctcatataataaaggaaagcacagacagatacagccttattagttacggtatatactgcagatgggttagcttatactaacttatcgtttccgaccgtcacccaaccggacggatgtgtttttcactaaattgtaagcaaacatgtcttgcaaggatttgtgcaatatgctaatatgatggtgatatatgtccgatgcacaaatgtacaatatgcggacacgggaacgaattccgagaaagtctgacagcgatcggaagcggcagtggaggtgccgctgaaaaagtcatattcactcaaattaggatgcttaaccttttgcaagcacagatttacgtgggaataaggcggctatgccgctttatcaataatggatagggaacagaaaggacatcatagtatgagtcaaaacgagaagaggttattcgacagacacaagaaacagaaagaactgcctttagagcagacgcaggcggtacctgcggtacaggatgaaatcacggcagagcctgcagccgaggcgccgcccaagcgcaacaaatacgcagacaaaatgaatcgcaaaaagcgcagactgagcaagggtgcgcgtatcggcattacggcggcggcagttgcgctgctgcttggcggcggcatctgggctgtggtgaaatcccgcgatgcgggcacggaggacgtgacgcagaccacggctatggtcagctgcggcgatctggagacctacatagagggaagcggcgttactgctgcaaaaaaacgcgaggaacttggccgggaggttaagggcaaggtaacacaggtgctggtcgccgagggcgacgaggtacacaccggcgatccgctgctggtgatcgacccgaccgaaacccgcaaggagcttgcggatgcacaaaaggaactgaccgaggcggaacgcggtgtctcggacgcgcagctggaggtctccaaggcacagtccgacttgagcgcggcgcagagaaaactgagccgtctgcacatcacggcgccgtttaccggcaaactgattccggccaaggattcggacgacaaggatgtgtccttccgtgtcggtgagcaggtgagcgagggtcaggtcatcggctacatggtaaatgaccgccagatgaagctgacgctggcgttcagcgccgaatatgcccgcagcattcgcaccggacagtcggccacggtatccatcgcttctgcgatgagcgaggtgagcggtacggtatcgtcggtcgagacagcacagcagatttcgagtgagggtgtgcgcgttatccgcgtcggcattacggtgaataaccccggttcgctgacaaagggtatgacagccaccgcgacgatcaatgccgggcgcctcggtgcgatctatccggcgagcgcgggcacactggaatacagccgcgaggaagccgtcaccgcacagatgagcggcgagatcatcaagctgaacggcacaagctacagcacctacaacggcggtgcgcttatcatgtccctgtcgagtgacgcttctcaggatgagattgcagccgcgcagaatggtattgcggcggcaaaccgcacggttgacagtgcaaagacggctgcaaacgaaaagcgggcacacattgccgaactgcagcagcagattcagaactcgaccgttacctctccgatggacggcattgttgtcagcctgaacgcggttgaaggacaggaggcgaccggctcggagacgctcgttgtggttgccgatttgaatgatattgtcgtcaacgccgaggtctcctcgatggatatcggctcggtgcagcaaggacagcaggcgactatgacgatgtacgcgtcggacggctccgagatttcgctgaccggcgaggtgcagtcggtagcgctggagccgacacagagctccggtgacgggcagggcagcatgccgaccttcaaggcggtcatttcggtggatccgctggagggacagaaaatttacagcggcatgtctatcgaatataaaatcacgacggcctcgtcctacggctgcctgatggtaccgtcgtcggctatcgtcaacacggacagcggcacagctgtattcgccaagccgctgacggacgagaacggaaacgagattccgtttgaggaaaccctgccgattcccgagggtaccgaaggcattccggaagactatcagcttgtaccggtcgagaccggcattgccgattcgaccaacacggaaatcctcggcggtctggaagagggcaccgaggtattcctcgccggtccgagcgatctgtacgccgaaatgtcgggtgacggcatgtccgccggtatgtccgtcggttgaggagggcgcgcttatgtgggaaagaaacgcgcagactcctgacacggagcgccgcgctgaattgctaattgacgttcagcgcatgagcaagatttacaacgaaggaagagaaaacgaagtgcgtgcactggatgacatctcgctgcaggtgcaatggggggagttcctgtgcattctgggacagtccggctcgggcaagtccacgctgatgaacattctcggctgtctggatattccaacctatggctcttatcatctaaacgggcagctggtcagcgatatgaagccgtccgtgctgtccggtatccgcaaccgggagatcgggtttatctttcagggctttaatctgattccggcgctgacggcgctcgaaaacgtcgagctgccgctcatctaccgcggtatgccgcgggaggaacgccgccgtctggcgcaggaggcgttagtctcggtcggtttggaaaagcgcatggatcaccgtccgggcgagatgtccggcggacagcagcagcgtgttgcgatcgcgcgtgcagtggcggcaaagccgccgatcatcatggcggacgagccgaccggcaatctggattctgcctccggtctggatattatgcgcaagctgactgcactcaatgagcagggaacctccatcatcctcatcacgcatgacaaccatcttgcacagatggcaaaacgcatcgtgacgatacaggacggcaggatcatttcggacacgaaaggaggggccgtatgaattggatgcagacggttcgtatggcgttcaagtccatcctgaacaacaaggttcgctcgattctgaccatgctcggcatcatcatcggtgtggcatcggttatcgctatcgtggcgtcgattcagggcacgagcaagctgcagcgcctgcagtatgaggcgatgggcgtcaaccgcatcgacatttacggatacggtgcgaaaaaccgcgattggcaggagtttgaggactatataacgaatgatttatccgacaaaatcgctgcatggtcgccgcagagccagtattacgactggcagaacagcggcatccagtaccgggccaaaaggctggataacaacgacagcaacagcggctacacttatatgtacttcggcaacgagcattacggcgaggtgacaagtcatgcgatttccgccggacgggatatttccgctgcggactgccgcacgcgcgcccgcgtctgtgtgatcggagaaacactgcgcaagtatttcttcggggcgatgagtccgatcgggcagaagctgcagattggcggcaagggttttgaggtcatcggcgtgtatgccggcaagtatgacggtaagctgaatacagaggatcagatgattgtgatgccgtacacgctgcagagcacgatgatgagtgtatacggcatggcagaccgccagtatatcgtgaaggcggcggacaaggaagcgattaccgagctgacagacgagcttctgccgggctttatgcagggccgctgcgaggcgggaaacggatacttttctgcttcgtcggacagccagtggcaggagcagagcgagtcctccaacaacatgcttgcgctgctcggcggcggtgtcgccggaatctcgctgcttgttggcggtatcggcattatgaatatcatgctggtgtctgttaccgagcgtacccgcgagatcggtatccgcatggcaatcggtgcccgcaagcgggatattatcgggcagtttctggtagaggcctcggtggtctcgtgctgtggaggtgtgatcggcattgtgctcggctgctttctttcggcggtgctgggcaatctgctgcttgcgaaaacgcagaacagttacatgccgaccgtggagcagttcaccgtactgccctctgcgggactggtcatcggcgcatttctgttttctgcgctgctgggtatcatcttcggactgtatcccgccaataaagcctcgaatctgcagccggtagatgcgctgcggacgcagtaaaaggaaaggacaggtaggaaaatgaaaaaaagatttgtcagcctgtgtctggcaggcttgattatggttgcaccggcttcggcggtgtttaccgatatttcagacagcagggtatcgcagacggccgccgttctggatgcactgggtatcatgcagggcgtaggcggcggcagcttcgcgccgggcaaggcgctgacgcgggcgcagttctgcaagctggcggttaccgccatgggtgtgacggatgtaagtccgtatgccagctacacgatttttccggatgttaagcattcgcactgggcagcgccgtatatcaacgcggcagtacgccatccggaactgaaggaaaaggccattatccgcggctatgcggacggcagcttcggcccggataagattgtcagctacggcgaggtctgcaccatgctgctgcgtatgctggggtataaagaggaggatgtcggtccgttctggcctgcagactatatcgcgcaggcacaggccatcggtctgacggacggtgtcacgattgcggatgcacatgccgcggtcaagcgcggggatgcggcggtgcttctgctgaacgctctgaatacggataaaaagggagaagagggcagcacactgcttgacaaggtcgcgtcctcgacggtcaaggactgcattctgctcgagaccggaaagacatacagcgcccttgctgcggatgcggcagtgttctatgaggacggtgttgtggatacggaatctccccgtaagaccgccggtacgctggacagcagcatgattggcgtgtacggcacgatcgttatcggcaagggcagcagcaaggttgcggtcggtgtgattccgaacggcaacaagaccgaaacttatgaggttgtcaatgcggaagcggatcgtatcgttaccacgaacggaacactgcgtccggaccgtaagaccaagctgtatatcagccgcgatcatgccatgggcgagtatgaaaatgtatgggcgaacctgcagagcggagatacactgagcctgtactataatgagtacggtgtgctgcagctgatggcagtcctgccgaaaacgacagcaggcaccgcgcactcgttcgtttacggtctggcgacatcgcgcaggattccggcggagtatacgatcatcaaaaacggtgcgaagatcgacgcgagcaagctgaaaaagtacgatgttgtgacgctcgatgccgcaaaccgtcaggcgatcgtttcggacaccaggctgagcggaaaatatcagactgactcgacaacgtacagtcatccctctcaggtggagattctgagacagaaattctcggtttcctccgaggcggcggcaacgttcaaggatatgaagctgaacgattacatcacgctgctgtttgacgcggacggcaatgttgcggctgcgtatccgaaaaaggatgtcagcgcggagatgcagggcattgtcaccaaaattggcggggaaaaggccacggtcacgctgacaaacggtctgaccctgcgggatattccgatcgccaaggacgtaaaaaccgatgtgatgggtcgccttgttacggtcagccagtccggtgagggggcagacctgattcgccgcacgctttccggaaagaccgccggaaactggtctgttgcggagggcaagctgggcggtaacgccgtttcctccaaggtgcgcgtgtatgaggaggtgctctccggcgcaccgctgaacgcgatcaacgtcagcgatattgacctgacctcggttccggcttcgcagattaagtataccgtgcaggataatgcaggtacggttacgaatattgttctgggcgatgtgaccggagaaagctggatttatggtattggctatggcaagcggatcaaaggagatcttcatataccctctaattggaatgatatgtctgaagagaaacagaaagaatatgaaaaagaccccgatcactacaactatacatatgcggttattcctaaatactgggagaacggaaaaacggtagaggataaagaatatcgtgtagtatctctgccgagcggcttaaacggcaatccgattggcattcccagagggtactcaaccgatgcaagcatcgtcaatacctcactggatacgctcaagctgacattgatcgacacggtaaagccgtcggcatttgacggttcctccggtgtccgtaccaaggacggctattacgagctggcaaagaatatcggcgtttatatctcggagcagaacaggtttatttcgctgcagacggcgaaatccaactacacgagcttccgcgtatacgccaataaaacagcggaaaacggcggaaaaatccgtgtgatcgtcgcttcgtgatttgctgtgtgctgcggttatagttttctgttaaataattgaaattgcaaaaacggatgcttctctgtacatggagaggcatccgttttgtttcagcttggattttaatgcagttttcaggattttaaaaacgccaaataaattacaaaaaagccgctctttccaacgaaagaacggctttatctggtccgagtgacaggacttgaacctgcggcctcttgacccccagtcaagcacgctaccagctgcgctacacccggatttgcaacggtctatcaaaccttgcctaaataggataccaaatccggagggaaaagtcaagtgttttgtgaaaatttctgcagcaaatttgcgtcatgccgcttgttttgagcgccgccgcaccgtcaaccccagcgaaaccgcatacacgctgagagaacccatcgcaaacacggccattatcatcaagacgagcaatccgtcagcagcagggagcgccccggattcctgaatctctacatcgcacaggcgcgcgatgtgcagcggcagactcagccaatccgcgagcaaatgcgctgccagaaccgtacccagccacagcagcgaatctttgaccggacgaaacgcagacgtgcgtgtcacgcaacgcgagagcagaaaaccggtcggcacagcgaccacaatcgctgcaaacacgccctccgtgcgccagacgccagtgcagccagaaatgccatctcatacactaagccgcacgcgacataatacgctttcctcatccgaacacctgatttctctcggtacaaaaagaagcccgccgaagcggactccttttctcatttgattactgaacttccgctgcctcaacctcacgcttttcctccgcgatatgatgcttattcgcgtagccggtcagaataagcgtcagcgcgccgtcaccggtgacgttgcaggcggtgccgaagctgtcctgcagggcaaagatggtcagcataagcgcggtgccggtgccgtcaaacagcaggatgccggtgatcagaccgagcgaagccataaccgtaccgcccggcacgccgggtgcgccgatggcaaaaatgccgagcagcacgcagaacaggatcatggttccgacagacggaatcttgccgtacagaatctgcgagactgtcatgacgaagaaaacctcggtcagcaccgagccgcacagatggatgttggcgaacagcgggataccgaaatcgaccatgtccttacgcagtaccgtggatttctttgcgcagcgcagagcaactgccaatgtcgcagcggaggacatcgtgccgactgcggtgatgtacgccggaccgtagtgcttcactacttcgatcgggttcttgcccgagtacgcgcccgcaactccatagagcagcgccatccagatataatgaccgatcataacgatgatgatgaccttgatgaacaccggaaactgcttggtgatcgtgccctcatacgccagaccgcagaaggtggacgcgataaagaacggcagaatcgggatgatgatcttggtgacgatggcgaggacaatgttctgcacctcgtcaagcagggactccatcattttggatttggtccaggtgatggccagaccgaccatcagcgacagcgccagtgcgctcatcacgttcatgatcgccgggatctccagctggaacattacctcgggcagctcgcgcaggccgtcaacctgcgatacgatcgacaggtgcggaatgagtgtgtaaccggctgccgtgctcatcagcgccgcgccgaccgacgacacatatgcgataatgagcgcaatgcccagcattctggatgcgttgtggcccagcttggtgatggacggcgcaataaagccgataacgatcagcggcacacagaacgtgatgatctgaccgagcacctgcttgatcgtcacgaccacgttcatcacggcctcgttcgccaccagaccgagcacgatgcccaccgcaacgccaagcagcagcttgaacggcaggctgtttagaatttttttcatacctacatactccctttgtttgcgttgcatctggatgacatcggcggatttcccctcagcctgtcacgctgccgccaagttgccatgtggacacaatgatatacctatatgatacaatttacagcgcgtttcgtcaaggcaaatacgggaaatggctgcgccaaataaaaacagagcggtttttttctgcaatttatggtatacttaaggcaatacagaaacaccgacaagggaggtaaaaccatgtcacaaaccttaaccataacggcggagcaggtgcttgcgtcggcagagcgcatccgagaggatattgtccgcgaccggcggacgctgcacgctgcacccgaggtcggcaccgacctgccgaacaccgtagcctgcgtcaaaaaacgcttgcttgagatgggctatcagccgcgcgagctggcaggcggcgtcgtcgcggagataaccggcaccgagaccggccactgtctgctcctgcgcgccgacatggacgcgctgcgtgtgaccgagcagaccggactggattttgcatccgcgaacggctgcatgcacgcctgcggccacgatatgcacacggcgatgctgctcggtgcggcaaagctgctgcgcgagtaccaaggtgagctgaacggcacggtcaagctggtgtttcagccggacgaggagggctttaccggcgcgaaggccatgctctcggcgggcgtgctgaaagacccggcaccgcaggcaggctttgcgctgcacgtcaattcgggcacgccgtccggactggttctgtgcggacgcggcacgtttatggcgggctgtacgctgttccgcattacggtaaacggcgttggatgccacggcgcaatgccggaaaagggcgtggacccgctcaatatcgcaagccacatttacctgtcgctgcaggagatcatcagccgcgagatcggcgcaaaaacgcctgctgtcgtgaccatcggccgcatgaccggcggtgaggcgcccaatatcatcccgcagaccgcggtgctcgagggcaccatccgcagctttgaccgcgacctgtccgcgcagatcttcacccgcatcggggaaatcgcccggtgcaccgcacaggcgttccgcggcacagctgtcacggaagagatcgtgtccgcgccgccgctcaggaatgatgctgcgctgaccaatcgtatggcagaccttgccggggcgctgttcggtgaaaagctggtctatcggctggacgagggcggcatgggctcggaggatttcgcgtcctacacctacgatttaccgtgcgcatacctgctcatcggtgcaggcaccaagcaggaaaatcctgcgttcggtgagccgatgcacaacgaaagggtcgtgttcaacgaggatatcctgccgcgcggcgcagcactgcatacatggtgcgcgctgaactggctggcagacgagggtaacgcatgaaaaccgaacaactcttcatcgaaaacacaccggcggtgctgtacggcgagccgtcggacacgctgtggctgttcgttcacggacaattcggctgcaaggaagaagccctgccgtttgccgaaatcgtggctccggacgcacaggttttgtccatcgacctgccgaatcacggcacacgccaaaaccgggatgaggaatttgcaccatggacagccgcatccgaactcacccgcgtgatggcttacgcaagagcacactggcgcgcgacaaacgtgcgcgcgaccagcatcggggcgtattttgcgcggctggcgtttgccgcaccggaaaaagcgctgttcgtgtcgcccatcgtggatatggagcgcttgatctgcgacagaatatgcgcggcaggtattaccgagcaaatcctgcgcgagcgcggcatgtatcccgcaagggaaggggatatgctctcgtgggactacctttgctgggtgcgtgcgcatccggcaaaggactggtactgcccgcagtacattctctacggcgaaaatgacagcatgactgacttggcgactatccgcacttacacggcaaaatccggtgcggagctgatcatcgtgccgcaaggcgagcactggttccacacaccggagcagctggccgttatggccgactgggaacgcaaacataaataaggagcacaatatgattcaggaaatctgcaaagatgagaaatttttagcgcagaaggccgagcaggccacgccggacgatatccaaaccgcaaccgacctgctggaaacgctcgaagcgcataaggacggctgtgtcggcatggcggcgaacatgatcggcgtgaacaagcgcatcatcgcgttcgataacgagggaacgtacatggtgatgttcaacccgcaaatcgtcaagcagtccggcggctatgaggccgaggagggctgtctgtcgctgaccggcacgcgcaaaacgcgccgctggcaatccatcaaggtgcagtaccagaacgaaaagttccagacacggctgaaaacctttaccggctggaccgcgcagattatccagcatgagatcgaccattgcgagggtattatcatctgagaaataagcaaaacgtaaaccaacgcatacaaaaaggcacaccaaacggtgtgccttttttctgccgttcgcgcaagcgcaggcagcggcgtaccgcagtacgccgattcaattccctgaaaaagtccggctctgccggactttttctccactgcccgtgccgcagcggcacggcctcgtccgttgtgcggacgagagggggatatcccacaaagtttctacggaactttgtgggtatctaagggggacagcgtcccccttagaagaaggtttagcccggcggccaggtcatatcccgcccggaaagaacgtggaaatgcagatggaacacgctctgacccgcctgttctccgatgttggagaccacgcggaagctgtccatgccgcgctccttggcaatcttcgcaatgacctcaaagcagtgcgctacaaccgcgctgttggacgcatcaacggcggccacagacttgatgtgctgcttcgggatcacgagaaaatgcgtgggagcctgcgggtcaatgtcgttgaaggcgtagcagaggtcgtcctcgtacaccttgctcgacgggatatcgcccgcgatgattttacagaacagacaatcttccatggaatgatcgctcctttctgaatgggtgtgccgcgggaggatttcccgcggtgttgccctgatttacggtttacagcattgcgtcaacgatgttattgacagcctcgagtgcttcctccagctttgccggattcttgccgcctgcggttgcgctgtccggacggccgccgccgccgccgccaacgatcttggcaacttccttgatgatcttgccggcgtgtgcgcccttcttaacagcttcagcgccgcagacacaaagcaggcttaccttgtcgccgttgactgcggagagaacggcaaccatgttgtcctttttgcccttgatgtcgtcacccatggtgcgcagcatgtcggcagatgcgtcatccagcttggtggcaaccacttctacacccttgatgttgcgggatacgttgaacaggtcaaccatctgcattgcagcgacctttgcgcccatcttctcgagcttcttgttgagagcacgcatatcgtttacctgctgctcaatcttggcagccagctcgttcgggttggtcttgagtgcagcagcggcctcgttgagaactgcctgacggtcgttcatcagcttgaggacagccttgccggtaacggcctcgatacgacgcacgcctgcggcaacagaagcctcaccaatgatcttgagcgaaccggccttggcagtgttgtccagatgcgtaccgccgcaaagctcgatggagtcgccggcctgaaccacgcggacggtctggccgtacttctcgccgaacagcgccatagcgcccttcttcttggcatcgtcgatgctcatttcctcggtgataaccgggctgccagccagaatcgcatcgttaaccatatcctcgaccttagccagctcctcagcggtcagcgctgcaaagtgggtgaagtcgaagcggatatgatcgtttgcagtgtaggagcctgcctgctcaacatggtcgccgagcacggtgcggagcgccttctggagcaggtgggtggaggtatgtgcacggcagatagcctgacggtaagccgcatcaacagaagccgtaacctcgtcctcaacggacagctcgccctcggtgacaacgccgatgtgcatatacttgccgtccttggtcttctgcacgtcggaaacggccatagcgccgttcttgccggtgataacgccgtggtcaccgatctgaccgcccatctccgcgtagaacggggtgcggtcgagtacaacggtaatcttctcacccttggcagctgcgccggaaacctcgccctcgtttacgatagccagaatctttgcggactcctcgagggtggtgtagccatcaaatgcggtcttgatggacttgtccagacccagatcctcgctctgccagccgagatcgcccatcttcttgcggtcttcacgggcacgctcgcgctgctcgttcatcaggcggtcgaactcctcgcggctggtggtcatgccctgctcctcgagtacctcaagggtcaggtcgatcgggaagccgtaggtgtcatacagctggaatgcgtccgcagcggacagctccttgccgtcggaagcggcgatcttgtcattcaggatagcaagaccgctgtcgatggtcttgttgaagctggcttcctcgttctcgataaccttgtggatatatttctgcttctcaaccagctccggatatgcgccgccggactcgttgataacggtggaagcaacgtcggacataaacggcttgtcaatgccgagcagcttgccgtgacgaacggcgcggcgcagcaggcggcgcagaacgtagccgcggccctcgttggacggaataacgccgtcgcagatcatcataacggtggagcggatgtggtcggtgataacacgcagggaaacatcggtcttgtcgctgtcgccgtagtgcttgccggcgatctcggaaaccttgttggtgatgttgcgcacggtgtcaacgtcgaacagggagccaacgccctgaaccacgcacgccagacgctccagacccatgccggtgtcgatgttcttctgcttcagctcagagtagttgccgtggccgtcgttgtcgaactgggagaatacgttgttccatacctccatgtagcggtcacagtcgcagccgacggtgcagccgggcttgccgcagccgtactcagggccgcggtcgtagtagatctcagagcacgggccgcacggaccggagccatgctcccagaagttgtcctccttgccgaagcggaagatacgctccggtgcaatgccgatctccttgttccagatctcgaatgcctcgtcatcgtcaacgtagatggacggatacaggcgatccgggtcaatgccgacccactccggactagtcagaaattcccagctccagtgaatggcctcgcgcttgaagtagtcgccgaaggagaagttgcccagcatctcgaagaaggtgccgtgacgggcggtcttgccaacgttctcgatatcgccggtgcggatgcacttctggcaggtggtaacgcggtggcgcggcggctcctgctcgccggtgaagaacggcttcatcggcgccatgccggagttgatgagcagaagcgacgggtcgttctgcgggatgagcgaaaagctcggcaggcggagatgacccttggtttcaaagaaactgaggtacatctcgcgcagctcgttgagtcctctgtactgcatataaattgattcctccaaaaaagaatttacggaaataaaacagaaaatgaaaaaagcctccgcccggacttcaagggcgaaagcatgcttccacggtaccaccttgatttgaatatgggtatgccatatccatctcggtaatccggtatcggggatcggacggtctgtttcagttgcagactgctcggaagtggctgttttccgcaccggacaaggacttgcagcgaatgtcctctctctgaagaacggcggatggaaaactcgtttcctcatcgcattttctgtattgcgtatctattatgccacttttgcgggcagttgtcaactgaaatcgcggaaagttgcgctctgcggagtgtgcggcgcccgccgcgggggcaaaaaggaagggacacctgcggtttcccttcctctttgaactcctacctttcccttgttagatagtctggcgcagaccagagaccggcaaccgctccgaaaataggaaacggcagtcgggttatcgttgcatttatttcgtgaaatattcgcagttatcggataccttactgctacacagacggttaactcaacgcaggcgcgacatacccgtgtcgcgcaattcgtttgcacgttgttacgcccggcccctgcgaatgtaggcgttcggcagcatttatcctcgcaggccctgtctatcataacgtgctaaagaattgtgcggcactgtcatgccgcacccagcgtagagttgcccgtatgtgtagcagaacgctatctgtgaactgcaaacaggttgcgaaagaaacgctgcggtaacccgactgccgttcccttatttcgcagcggtcgccgctctccgattttcgtcgtgctaatagggaaaggggagattcacaagagggtagaaaccgtaggtgtctaccctcttgcccctcgccgtgggtacggcgaatctccgcgctccgaagagcgcaactcctcgctgaggttcagcgaaaaacccccgcccgtcaggggcgaactcgcctgcggcagttcgtgtgccccggtcagccggggcagaaaaaggagccgcccgtcagggggcgaacacgctaacgcaattcgtatgccccggaaattcggtgcagaaaaaggagcccgccttgcagcgagccccaaagagagaggataaattcgattttaaccttctgcggtatccggccgagtcaccttcttgacccacttccagctgtgcaggcggatagccacgggaatgatcttatacaactgatcccacttgagcaggaagaatacgacaaccggcgggaacttccaccagaaagccgccattgccgagaacggcacaacgataagccacatgctgatgatattcatcttggcgctgaacttggtgtcgccgccgccgcggatgatgccgttatcgcacgccatctggtacgaggtgccgaccgttgtgatggcgagcaccagcatgaactgcagggaatacgtgtacgccgtttcggtgagcgtaccgccgagcagcgcaaggatcggtacgcgcagaaggaagatcaaaagacccgagcacagtccgatggagacgaacaggacctgcagcgtatgtacaagcggacgcagccgctgctggttgccctcgccgatggtgcggccgaccacaatgccggatgcggacgcggcgccatagcagacaaccgacagaacctgatatacctgcaccgcaatcgcattggcagccgtggcatcaccgccgagatgaccgaggataccggtctgtaccatctgcgcgatgccccagagcgcctgattgatgagcaccggcagggaaacgtgcatgtaatcctgcacatagctggtgtcgatgtgaaccagcttgcgcaggctcaggttcagcttgtgctccttaaacttcaggtagtagataacgatgagcagctccacacagcgggaaaccagcgttgcgatagccgcaccgcgcacgcccagctccggacagccgaagtggccgtagatcaggcagtagttcaggcacacgttgatgatgagcgttgaacccgagatcatgtagccgatctttactacaccgatcgagcggagggatgcgaccagaatattggttattgtaaagataatataggtaaagcagatgatctggaaatacttttcaccttccgcgatgaccgttggcgagttggacagcagcgacagcagctggtgcgggaagaacagcacaatgccgaacatcagcaccgccagtgaaccgccgaagcgcaaagccacaccgatgatgtgcgggatcggctccagcttgtttttgccccagtactgcgagcccataacgaccgcgccctcgcctgcaccgacgaccagcatctgcagcagaaactgcacctgattgcacaggcttacgccgcccatggcatcctgactgtaccgtccgagcatcatggtgtccatcaggtttacgccgtaggtgagcaggttctgcagcgccagcgatagtgccagcaccataaaggatttataaaacgtcttttcctttatcattacaacaacccctttttgtggaggcaacaccgcataattaaactgcggctccttgcgcaggctccggtcgcgctgccgcgacgctttgcggtaattttgtgcgctgatgtcggcctcggttccttgcgcagactccggtcgcgctgccgcatctttttgcaatacacaaagtattgctgcaaagccgcgcctaatcagcacgcaaaattcctcacaaatcgctcttgtttaattatgcggtgttacctaaagccgaccaaatgagatagaccgcaatatctatcgttccggctcagcttttttacttctgctaacagcataccgaattttctttgatttggcaataacaaaatactgcaatctattcatattttgtgctatcatagaaggcagaggagggaatgccgtgaaggttttcagtgagccgggtgtgctgtcgcgctcggaacgatttttctcaacgccgtccgcaacggctcggcggctgttttactatgtcacccgcgtgggacattattactacgatgcgcggtataattttctcgacagctgcgacatcgcccatctggaaagccacaagaatctctttctgacctacgttcgctcgggtacgatgtacttcgagaccgaccagctctactgcgccgagcgcggacagatcggactggtggactgccgcagaccgcatcatttttataccaagggcgacgcggaagcgctctggattcactttgacggcgcaaatgcggcggcatttttcgagcagatactcgcgttccgcggcggcaggcaggtgcttacgccgccggcggatttacgcatcgagcaggagctggcacagatcatttccggcttgcgcaccggcgacatgaccgagcttgaccgctcgcagcgtatctaccgaatcctgtgcgcgctgctgtttccggcgcaggcgggacccgaccggaaaaacgatgccattgcacaggcggtcaagtatatcggagaacacctgtttgaatcgttgtccgtggagaaggtggcggacgcggtcagcctgagtccgtcgcatttctcgcggctgttccgcagcacgaccggattttccccgcacgagtacatcatgctgcaccggatcgacgaggccaaggccctgctgcagtccacgacgctttcggtcaaggaaattgcgttccgcgtcggttaccgcagtgaggtcaactttattacagccttcaccgagaaaaccggcgcaacaccgacccagttccgcagaaatacgctgtaagtcggtctgcggttgcggcgcgttccggtctttgctataatagtagaaaaggcaagggagtgaccccgtatgcgagaacgccctctggtttatctggtgccgccgatggctgccgcgctgtacgcggcagtctgtctggagctgccggtgcagcttggcattgccgcgccgatcgcgtttcttctggtgcttgcggctgtgtttctgcgccgccgcaagtgtctgctgaatgtgtttgctgtgctggcggctgccgctcttgcgctgaccggctttgctgtgttccgggatttgcgggtcgtgcccattcgtgctttagccggcgaaacgcaggagatcaccgcagccgccctgcgggatgccgaggtgtacgacaccgaccagcgcgtgctgctctcggcggagactgcagacggcaggcggtttcgcctgcggtgctacttgccggaaaccgaaccgccattgctggcaggagacagggtacgcgttatggtcacactttatgtgccggacacgctcggcggctttgaccgtgcggcgtatcaggcgtccgagggctgctatatcgcgggcgcgtatgcgaccgacgaggagcacaacgcggtgcagttcgaggtcttggactctaaacgggacagcctgcgctttgcgccgcagaggatcgcacggttctgccgaaatgcggtgcagcgtgcccttccggaacgtgaagccggtctgctgaccggactgctggtcggcggcagcaaaaatctgagcgacaccgaccagaccgcgttccgcattgcgggtctcagccatctggtggccgtttccggactgcatatcggctttctcgtcgggttctgcacgctgctgttcggcaaacggtggggaacggttgtgtccatcccgctggtgctgctgtttgtgccggtcgcgggagccacgccgtccgtgctgcgcgcggcactgatgtatctgacggccgcaggcggatttctgctccggcgccggtcgggcggattgaacgcgctgctgatggcactggctgttctgctgcttgtcaatccgtacgcgatcgcaagcgtgggcctgcagctttcattcgcgtccacgctcggtcttatcctgttcgcagggaagctgcagcatgcactcgaaaagccgtttgtcggtgcgccgaaactcgtgcgcaaggcgcttgcggtcatcacgagcgcactcagctgcacggtttgcgctacgatatttacagtaccgattctgctgacctcgttcggcgcggtgtccgtgctgtcgcccatcagcaacctgatgacggtcggcgtgacctcgctctgctttgtgggcgggttcgtgctgtgtgttgcagcagccgtctgtccggcgcttgtgccgatgctcgccggactggtgcgtccgctcataagctatctgctctggtcagcgaatatcatcgcggacctcggcttcggcacgctgcacccgaacaacaccttcggtctggcggcgctcggcatcgtgttcgcggcgctgctcgtgtggctgactgccggaaagcacgtcaaatggaaagccgtgctgccgtgtctggcggtggtgctgatcggcttatgtattgccgaggtgcagcaccagaacggccggtatacggtgacgtatctgccgtgcggcagcggtcaggccattctgctgagcgacaccgaacacgcgatgctcatagactgcggcagctaccggaacgctgcgcgtcaggtacgcgagtggctacgctggaatggtctgaagcggctggatacggtcgtgctgaccgcggtcgatcagggacatgcgcgcaacctgccggagctgatggaaacggtcgaggttggggaactgctcatgcccgcaggctgtcaggagcgcaggaccaacgccgatttgctttccttcgtgcacgagcgtaaggcgcaggaggtaagcgagccggtgatgctcacgaacccgatcgcgccggtagaacttttcccgatcaccgagggaaaactggccgtaagcatagcgaacgaggtgctcatcctgcacagtccgaccgagaagcagctttcagcctatttggaacaaaacacgctgcctgccgcagcggagctggtgctcagcgcgaaccatctgagcagcggcgaaagcatggcacaatacgctgaagcggcaggcgcacagcatatcatcattgcggcgagttcggagaagggactgcggtcgcacaagggactggacgtgcagagcacctataaggaaggcgagatcgcacggcagttcaaaaaggagtaacacatggcggcaagagaaaccaaaccaaacggaaaatcacagctgatccgcgacctgaaaaacggcgaatttgccacgctgtacatcatttcgggcgaggaaagctacatgaaggaatactatctgcggcagctgcggcagaaggtggtggacgagacctttgcggatttcaatcttattgagttcgagggcaagggtctgacaccggaaatgctgaccgaggctattgacagctatcccgcgatggcagataaaaagctcatcatcgtcaaggacttcgacctgttcaagccgcctgccggcttcgcagacgtgctgccgagcgtacttggtgatctgccggagtacgtctgcctcgtgttctactacgacgtgctggacggcaagccggacaagcgcaccaagctgtacaaaacgctcgagaagcacgcctgctttgccgagttcgcacacgcagaggagcaggagctggtggcgtggctcgagcgtcgtgcaaaggcactcggctgcatgatcgaaccgggagatgcgtcgtacatgatcttcctgtgcggcaattccatgaccaacctcgccggtgaaatggaaaaggcagccgcgcacaccacgaccggcgttatcaagcgctataatatcgatgcggtatgctcgccggtgctggatgcagtcgtgttcgacctgaccgacgcggtaaccgcaggcaggtttgatcgggcggtcgcactcgtcggggagctgctcgcgcagaagaacaacgaggtcatgatcttcaccgccatcacacgtcacatccagcgtctgtatgctgccaagttgtgcgcggagaaccgcggcggagaaaaacagctgatggagatgatcggctcgaaatcgccgtactacgcaaggcagattcagaatgcagcacggcgtgtgccgctcagctggctgcgaaaggcggcgtcgctgtgcgcggagaccgatgccgcactcaagggcggcgcagcagaccggcagaagcagatcgagctgacgctgctcaccatggcggcagagctgaagggggaaaagaaatgacgcgcatcagggaagcaattctggtagagggccggtatgatgtgaacaccgtccggcaggtggtggacaccgtggtgcttgaaagcggcggattccgcatttttaacaataaagaccagctcaagctgctgcgccgtatcgcggaaacgcgcggtctcattgtgctgaccgacagtgacggtgcgggctttgtcatccgcaactatctcaagggcgcgctgccgaagggctgcgtcaagcaggcgtatgtgcccgatatcgcgggcaaggaacgccgcaagcggcacggctccaaggagggcaagctgggcgtggagggcatgcgtccgcaggtgattctggatgcgctccgccgagcgggtgcaacctttgcacagcaggacgagagcgaaacgccggtgcatcctgtcatcaccaaggcggatttttacgagtggggactgtccggcagaccggacagcaccgcacgccgcgctgccgtgctgcacgcgctggatttgcccgagcacatgacggcaaatgctctgctggagtttatcaacgctgttggcacgcatgagcaggttgcggaaatcattcagcagtacgcggagaaaaccgagaaaattgaggaataatttccgcacgaatgattgaaaaacctgtcgaagtatagtacaatggtaaaataccaagtgcagctattgcagagctgatgaaaataaagcaaaaaacagggagtggcagcatgaactttttagaggaacgaattgtcaaggatggcgttgttaaggaaggcaacattctgaaggtagacagctttctgaaccatcagatggatattaacctgtttgatcagatgggcgaggagttcaagcgccgtttcgcggacaagccgatcaacaagatcgttaccattgaggcatccggtattggcattgcctgcattgtggcacgtcatttcggcgttccggtcgtgtttgcaaagaagacccagagtgtcaacatcgacggcgaggtttatgttgccgaggtcgaatcctttacgcataagtgtaagaatcaggttatcgtttctaagaagttcctcggtccggacgaccatgtgcttgttatcgatgattttttggcaaacggctgtgcgctgcagggcctgatctccatcgtggcacaggccggcggtacggttgagggcatcggcatcgccgtggagaagggtttccagcagggcggccgtattatccgcaatctgggctatcagctcgagtcgctcgctatcgtggagggcatggacgctgagaccggtgaggtgcactttagagagcagtaaatagaaagtttgaaaggggaaggcgttgagccttcctctttttgtttgcgggagtggggattagatgaaagacaggagttaggagttttcggagagtgaagagaaacgatgttttaccctttttcatgttttatattacatatatcgtagggtgcgatgactcggcgcaccgcattgaacgattggcacatgttatatcgtaggggagcacattgtgctcccacgcaacgccatatcgaacgtgttctcgggcgcacatggtgcgcccctgcggttaggcaaggcgcagatgagttacatacggtgtgacgagtcgtcgcaccctacggtaaagtgtgttgataaatatcattcgcaggcgccgtgcatgatcaccagacatgtgaattgcgaatatttcacgaaacaaacgcaagagtaacccgactgccgttctccttttcgaagttgcagaaaaacaggggagactgcgaaacccatcgaaaaatgaaatggctgagttgcaatagtaaacttgccaaagactgaattgcataatttaggtaatatatataaagcatacaatatcttcgctttttaggcttgcatacaccgttttatcacgcttttcggtattttaagtacgccgataaggagtggcttttttcgccactcctaaaatgagaaaatatgcgatttggacggtttattcctgctgcatatacagttcgtacactgtattggaagttgaccagttgagaaccttgtgtggatagttattgatccagtcctgcaaggcagcgatctgtgctgccgtcactttggagaagtcagtaccttttggaaaccatcgccggattagacggttagcgttctcattagaaccgcacctccactcgatgtgatcgactcctatgccaagcgctttccgaaagcggttcagtgtcttgaggacggattggaagattctctggccttctatgcattcccaatgctggacgcacgaaaaatctcatcttccaacatgattgagagattaaatcgtgaaatccgcagacgtaccagcgtgattggaatctttccgaatgaaagttcgtatgttcgtctggagacagcgtatctcatggaatacgccgaggactggtctgtttccagagcctacataagccatgcatccattgcggccacactgactaccgcagcttaacttcatttttcaagagcctttttgcgaactttacttgacgtcgccgacagcgcatgcgtcacacgcagaaagccctccagaccgacacagccgtactgctcgagaagctgctccatatgtttgcgtcgtttgggcgctctgcgcttctcaagccacgccgtgagcgattgcagaccgattgaccgcaggtcggtataccactcacgaagaatagcactctcctcgccaaattcatcctgcgcgcaggagaacagcgcatacggcacatccttattcatcaggatatactctgtcgcgttcctcacctctgtaccttctcaaacaccctctccgctaccgcttcgcactcctcgggcgtgcaccgaaacgagcgggtgccaaaggaagcgcgaaacgtctcgtaaagcgcagacagataattcggccggaacggcctgccgtcctccatcacgaccacataatcgttatcgtcgtaggcattcttatattctgccctgcacgcctactgattctccttcgccgccttcagcatatcgcacagtgtatccggcaggtacagcgtgcgcgtagaggacgtcgttttcgtgcctttctcgatttccttttaccagcctgcgtgcgcgtattctcaatcgtgatggtctggtgttcaaggtcaatatcgctccaccgcagaccgcacagctcgccgcggcgcagtccgagatacgcacagatatacatcggcaactcgagccgcgttccgacagccttggcgagcagaacaccaagctgttcgggcgtgtaaaacttcgcctcgcgctgacgctttttcggcggcgagaccgcacgcatcggatttttcgtgatgtactcctgccgctccgccgcgttcagtgtgttcgtcagcagattatgatgcttgatgaccgtatgccgtcgtttgctcgatctgcggcacgataatattattgtaccagtagtcaagccgctgcgcgaacgcgtactcgctcggcatgatctgcgtccccctgtccttcttgaccttgtgctcattgaacgcacgggtcgcgtcgcgcttcgtgtcgaacgtccggtacttgcgaacacgctttccctcgcggtcaacgccgtagtcaaagcacacgcggtacttgtcgccgcgctgcgtaatgctgccatatgccatgcttctcgactctgtggcttaacgatgccatggaattttgcggctgtcaatggctacaaattgttgcaacgcaaaatcgcattctcacaaaaatattatttgctgcagataaaagcaaaaccgacggtttaaaccgtcggttttgtgttagttttggtggagccgaggggagttgaacccctgtccgaaagcgcatccacgaggacttctccgggcgcagtttgtcgattaagattcccgccgcggcacgccggcaaacaggcttaccgttttggtagagtcattttacatgacgagggcaactcttacctcgtacacgttcaccactaatcgacgccgggtctctgagccgtggtcctctctgagccgacgggctaagcctaattaggcagcctgaagagtataattgttgttgtttaatttataaacagttggagcttttatcgcagatccccactgcggcccgctatcccggcttcaacacccccgtcgaacccgttacggccccattttgaaatggagaatggaaaattgagaatagcgaatgattctgctctcagcttttccatttttttaattaacgattacgctctttcatcgcacggtccatctcgcgttttgcatcgcgtgcggcgatactgtcacgcttatcgtgcagctttttgcccttgcacaaaccgatttcaaccttcacgcgcgagcttttgaaataaaccgccagcggaatgaccgaatagccgtcctgcttggtcttgctgaacaggttgacgatctcgcgcttgtgcatgagcagcttacgcacgcgcaacgggtccttattgaagatgttgcccttttcatacggcgaaatgtgcatgccgcgcacgaaaatctcaccatccttgaacgaacagtaggaatccttgagattgatctgtcccagacggatggactttacctcggtacccgcaagctcgatgcccgcttcatacttttcctcgacaaagtagtcatgccatgcctttttgttggccgcaatctgctttgtgccctttttgtcaacagccatggcgaaacctcccttaccgtggtatagattataataccacgatataccgtttttgtaaagtggcaaccgcattacatttttcgacgaaaaatgtaatattaaacttaccacgaggaacacacctcaaaggtaagttttttatatctgtataacagaagactaactattagaagtcaaccccaaatgtgtggaaaggtgaaaataatgcagacgattcaaaaaaggtatggcaaagctgacgtccgtcggacgcctaactgagcttattataagaacttaagctgcacgcctgtacggctgccgagatttctccaaggcgtagatcagccgaaccaatttcttagcggcatgagaaagtgcaacattgtaatgctttccttcagctcgctttttagcaaggtaagccgcaaagcccggatcccaatggcagacatacttggtcgcgttgtaaagcgcatagcgcaagtagcgagagcctcgtttctccatgtgagagtaggttccagccaatgaaagatgccctgattgataggtggacggtgacatgcctgcataggcaaggatcttgtctggagaatcgaaaaaggagaaatcaccgatttcggcaaggatcatagctgccatgcgaaaacccatgccgggaatagtcgtaatgggagactgaagttcttccatgatggcctcaatagctgcttcaatatctttaatctctgaatctaattcacggatcaagcggattgtatgacgcaactcaagcgatttagcgggcataacagaaccgattgaacgcttggcagcatcacgaatttctgttgccatatctcgtccatatcggcctttagaggcatctttcaggagagatttcaagtgcgtcaaatgagcttcggcaatctgctttgctccgggaaattcaatgagaagtgcgtaaacagacgacatatgcagcgttggcaccagtttttctaactctggaaacagtatggtaaccaaacgagaaaccgattgtttcagttgagctctttcttgaactttatcaaatcggtatctggttagtgactttaactcttcgttgtggtatgctgtatctgtgtaggacttgaggtccacattagacataagcatagctgcgatagttttagcatcaacccgatcagtcttggttttacgaagactcatactttttcggaaaaggttggtgtgcagcggattgataacataggttggcaggccttggttaagcagaaatccgagaatgttgtagctgtaatgtccagtagcctcaagtcctacttttattttgtcatctggacttgtgcagccgtgaatcttttgtagcaaggtatcaaatccatctgcattattaggaatggtgaatacacctgcaaggactttcccttccgaattcaggataacgcaatcgtgcttatccttggcaacatcaatacccacacaaatcataatgaatacctccgatatgtttatttgatgccggttccacagaacactttactcttgtaaccttgttcaacataaaccgtctggcggtatctaactgattaacaataccgtaaagggctgtggtcggagccttccgtgaaccgtctgacggtaggagttgcgaaccaatccacagcatcctttacattgtagcacagcccttggagaggggatctaataactactactctataatacaaggaggtgctgtaaaatggctgaaatgggtccggttcgtaagatagatgatctcggtcgcgtagtcattcccaaggagtttcggaaaacctttaattggcccatcggcatggaggttgaaatttccgctgctgacgggaaagtaattgtcgcaaaacattcaacggcttgtatcttttgcggtaagccaactcgtgtgcaaatcggtgaacagcatatttgccctgcctgcgctgcaaagtatcaagcacagttcgatgaaatcgctcatatgtcgatggagtgaagttaatgtcgtatcgcttacacatcaccaagtcgagtgtgttccaatggaacacgcagacccaaaggaggacgattgatgacttatcagctttctgacaacccgtcttttcgcgagcgagtggggggtgccgtccgtacaggcggtcgtcaaggtcggtgacactgtatccgacatccgggagggcaggaacgccggtgtccgctcgctcggcgtgctcgagggcagcagtgtgatgggcatgacgcaggcagcctatgaggcgctctccgctgagaaaaagcaggccgcacttgaccgtgcgcggcagatgttcctcgaggccggcgccgatgatgtgctgctgaatatcgagcagctgctcgcatggattcaagcgaacaactaaaccagattaaggcactgcggcagtgcgaccggagcctgcacaaggagccgccgctttaattgtgcggtgttgccttaaatacaaaacccgaagtgcaggttttacacctgcacttcgggtttgctttttgctgtttttaatgctccgcccaatcaagcgaccgtccaaccgccttatcccagccggagagcagcttgcggcgtttattctcgtccattgagggcgcatacagcgtatcacaccgccagagctgcttcagctcctcgcggctgtgccacacaccggtcgcgagttcggcaagatagcatgcgccgagcgcggtcgtttcgcggatgaccggacggcgaatcgtgcagtccgaaatatcgctctggaactgcatcaggaagctgtcgcggctggcaccgccgtccacagaaagggaggagagggcagtgccggtatcgcgtttcatggcggtcagcaggtcgttcacctgataggcgatggactcctgtgcggcgcggatgatgtgctcgcgggtcgtgccgcgcgtcagaccgatgagacagccgcgtgcgtacatatcccaatgcggcgcgcccagaccggtgaatgcaggcacgaggtacacgccgccggtgtccttcaccttgcccgcgtagtattccgcatcgcggctctcggagaaaaagcgcatctcatcccgcagccactggatgacggcgccgccgacaaacacgctgccctcgagcgcgtactgcgtctctccgctgatttgaatgccgatggtggtcagcaggccgtttttgctctcgcaggcggttgtgccggtgttcatcagcagaaaacagcccgtgccgtaggtgtttttcgcatcgcctgccgcaaagcaggtctgaccgaacagcgccgcctgctggtcgcctgcaatgcctgcaatcggaatatcgccgcccggcagggcaacagaaccgtacacctcgcttgaggagcacacgcgcggcagcatcgcccggggaatatcgagcgcttcaagcagggtatcgtcccagtccagacggtgaatgtcgaagatcatcgtgcgtgcggcattggtcgcgtccgtaatgtgcaccttgccgccggtcagcttccacaccagccaggaatccaccgtgccgaacaggatttctccgcgctcggccttctctcgtgcgccctccacatggtcgagcagccacttgattttcgttcccgaaaaatacgcatccggaaccagaccggtcgtgcggcggatgtgtccggacagaccgtcctgcaccagtctgtccacaatatccgctgtgcggcggcactgccagacgatagcgttgtgaatcggccgtccggtatttttatcccacaggatggtcgtctcgcgctggttggtgatgccgatgcccgccacatcggacggagaaacatcggcggccgccagcacctcgagcatagctgcatattgcgtggaccagatttccatcggatcctgctcgacccatccctcgtgcggataatgctgggtcagctcatgctgccggatggcgagaatattctgttcgctgtcaaataagatcgctctcgagcttgtcgtgccctgatcgagcgccagtatatattttcccatagcggaaactcctttttactctttgcatctatcataccgttgcggatgcggattgtcaatcactgcaaatttgacggtgcggtgcattttgtggtaaaatcagtgcgaaaatgcatagaagaaggggattgcatgaggatttacgaatacggcgagccgaatgcgaaaaacgtgctgctgcagccggttggggaccacgacctgccagccatcgagaacgaaatccgagagatcaagcggatgactgcacagccgttccgtttgattgccgtcaaggttgaaaggtggaacgatgacctgtctccgtggtgtgcaccggcagttttcggtcatgaggatttcggagacggtgctgcggcactgctccgcgaaatcctgcctctttgtgaggacgcagacagacgatacatcatcggcggatactcgatggcagggctgtttgccctgtggagcgcatatcggaccgaccgtttttccggcatcgcggcagcctcgccgtctctgtggtttccgaaatttctggagtacatgcaggcgcatgatctgcacagcgctgccgtctatctcagcctgggcaaccgcgaggaaaagacacgcaatccggtgatggctgccgtcggtgaccgcatgcgggcagcgtatgcgctcctgcaggagaaaaacgtaagctgcacactggaatggaacagcggcgggcattttcagcagccggactgccgcacggcaaaggcgtttgcgtgggtactggaacacttattttattaaggtataacttatgcttgagaagtctgtcggattcctgtataataataaataaatgttaccggttgactacaaccgataacaaaagtactttggaaagggaatagaaattatgttggaaacgatcaactccgttatcgcagcgatatcggatgtactgtatcagccgtggtttgtgccgttgtttctgatagtcagcggcatttatttcacgttccgctgcaggttcatccagattcgtctgttcagggacgcgtgcaaggtcatcatggagaagccggaaagcgaggggagcatttcctcgttcggcgcactcatgatctccaccgcgtcgcgtgtcggcacgggcaacatcatcggtgtatccacggcaatctgcctcggcggaccgggcgctatcttctggatgtgggtaaccgcactgcttggcggtgcaaccgccttcatcgagtctacgctcgcgcagatttacaaaaagcgtgcaccggacggcagctgctacggcggtcctgcgtactacatgcgcgatgcactcggcaagcgctggatgggtgtcatcttctcggtgctcatcatcctgatctacgcagtcggctataacatgctggcggcgtacaatctgcagtccacattctcggtgttcaagttctaccatccggttatcacgccggcgttcatcggcgtcattctggcgttcctgttcggcgtaatggtactcggcggcgcaaagcgtctggcaagcatcaccgaaatccttgttccgttcatgggtatcctgtatgtactggtttcgctgctcatcatcttcctgaatatcaggaatgtaccgggcatgttcgcgtcgatcttccgcaacgcatttgacttccagtccgtgatgggcggcttctccggcagctgcatcatgtacggcgtgaagcgcggtctgtactcgaacgaagcaggtatgggctctgcaccgaatgcagccgcaaccgcatctgtttcccatccggccaagcagggtctggtgcagatgctgtccgtattcatcgacacgctgctcatctgtacggcaacggcgttcatgtgtctgtccaccagcgttgttccgaccgaggaaatcgccggtgcggtttatgtacagaatgctatcgcatccacgctcggtacggcaggtccggtgttccttgctgtggcgatgatgctgttcgcgttcaccacgctgctcggcaactactcatactgcgagggctgtctggagttcatcctgcatcgcagcatcaaaaagcatgagctgctcctcttccgtctgtttgctacggccatcgtgttcatcggtgcgattgcaaacgccggtctggtctgggatactgcggatatgctgcagggtatgatcgtcgtagtcaacgtgccgaccatcctgattcttggcggcacggcaatcaggtgcctgaatgattacgttgcaagccgcaagcgcggtgagaatccggtatttcacgcgaagaacattggcatcaaggaagaaactgattttggaaataagcgcataagaaaaggactgctgcacaaggataaaacctgtgcagcagtccttttttgttatgcgtttgtgttctcctgcggcggatttgccgttaaatcgcggaaatgctgcaggcgtgccgtccacagcatggtatcctgcggttcatccggcgagatcgagagattgttcttcgtccagtccgcgagaaacgcactgaatttctccgcaccgacacagttgtaatgcagtgagtcgtagaagtcgttttccggatctgcggcaatctgcgcggtgtagtcgttgcaattcagtgttgatacgccgtcgcgtccgtcaaactgcgcggtcagcctgtcccagtcagcgtcgtgcagacgctttgtcggagcacggtacagcaccagctgaatattgttcctgcggcagagcgcgtaaatatcttcgagggcacccgtgtttcgttcccagtcctccggggcaatatcaaccgtttcgcagtcgtccggacccttgtccgtgccgccggacagaaaggtgtagccggccagcatatcctcggtgtacggctgcacgtcctcgctcttgagggtcgtccagcggtcgtgatagaagtacagcggaaacagcagtcccttgcggacttcgggttcggcattaaaaaaggtcgcgtgcagacgattgatgccccacggcatctgaccgatgttggtcttggtgaagcccatgtatttgtggaacgcgataccggtgcactccacaaaaaccgccttgggtgactgcgtgcgcaggctttcctttaagtaatccagcgtcagcggaagcggctgctcgggtccggcctgcacaaaggcggtcagaccggaattttcccagtatacggcaggtaccacatcgcagtaggtgacggatgagccgaagaacagcacatcgatcgaatccgtctgctcctgttcgtacatgccccagaccgagccgtaatcatgctgctgcggtgtgagataatgggtcgcaccggcgaggataccgccgaacactgccgcagcggcaaggaaggccgccagttctcttttgaaaatgtgtttcacggcgattcctccttaaaactggaaatagacgaattcctgcgggttgaatccggtgccgtacgcgccgcacacggccgtcactgccagcaggataacccagaccgcgtaccggagccagacggtctccagcagcttttcccgcagcggaaaacggtcaccgatgatgtcggtcagcaccagtccgatgaggctcacggcaagcacatgcagcgcacgctcggtcagaccgagatgcgtcaggtcaagcgggaagcatgcgcctgccgccgtcacaatgcgtttgataatagcacacgcctgcaaagcagaatccgcgcggaagaatatccaagcaaacgtggaaaggccgaaggtgataatcacgcggatgatctgcagccagcctgcgtcccacgggatgtgcagtgcagcgcacaggcgctgctttgccggtgtcagcaggccgccgataacctgaaaaacgccgaacagcagtccccagagcacatatttcatggcggcaccgtgccacaggccgctcagtgcgaacacgatcagcacgttgatgtaggtgcgcgctttgcccttgcggctgccgccgagcgggaaatataagtagtcgcggaaccaggtggacaaggaaatgtgccatctgtgccagaattccttggagctttgcgccatgtacggtgcgtggaagttttccatcagcgtaatgccgaacagccgcgcggagccgatcgccatgtcggagtaggcggaaaagtcgcagtagatctgcagggcatacgccactgcggcgaacgccagctccagaccggaaaactgcgccggatcggcgtacgcagtgttgaccagaatcgccagattatccgcgagcagcaccttcttgactgtgccctcgatgagccgttcggcggcaaagcgcacatcgtccgcgtttgcgcggcgcggctgcttgaactgcgggagcaggctcttcgagcgctcgatcgggccggacaggatcgccggaaaaaaggtggtgaacagcgcaaaatcgaggaaattgcgctcggcttcacgaccgcggtacacgtcgatcatatagccgcagatgacgaacgtatagaacgaaatgccgatcggcagggccagctgcggcagactgagctgcacaccggtgcagccgagcagctctccgaaaaagccgaggtatttgaataacccgagtgcgccgaggttgagcacaagcaccagcgtgagcagaccgcgcttacgctcggtgcgttccagcttttgcgctgcaaagaagttgaaggcaacggtcagcgccagcagcggcagaaattttacaccgccgatggcgtaaaacatgaagttcagcagcagaaggaagggtttcttggccttctgtgacagtgggtggtaaatgagtgcgcctatcaccagaaagacgatataagcgaatgaatttggtgtcacgtttatttctctccgtccccaaaattatttgttgtatccggtcacgccgtttttattcatccaggtcagcttgacctgcagcaaacgggcgatcgccggattttcctgaccgtgccgggctgcatacagccgctgcagctcaagcaggtcgttataagcgaatgaatttggtgtcacgtttatttctctccgtccccaaaattatttgttgtatccggtcacgccgtttttattcatccaggtcagcttgacctgcagcaaacgggcgatcgccggattttcctgaccgtgccgggctgcatacagccgctgcagctcaagcaggtcgttgtaggtcaaatacggataatcctgcccggaacaggtgccgtccggcttgtaggagtagttcagatcaccgtccggcttgtaccacagcagttcgctttgctcaatgccgcgcaccatgcggtcggcgaggacggcgtagctgtcctcatcaactgcgtctgccatccggtacaggaattcggcttcggcggcatgatggttgagcgaagcgtgtgtcggcgaggactctccgttcgggtgccagtaatcctgcacgagccatccctcgtcatcgccggccccgaaggtgaagtgatgctgctcggcaaagctgacgagaaaattcgcatacttgcgggtcttgtccagccagccggtcacaccgaagttttcggctgcgttgatattcgccagccagaaatccgtgttgaagcgggtgtcgtagtagccgggttcgatgccgtaatccgtcttgagccatgtgctgcccgcctgagaggggataaagccgtactcgttctgctgctcgcgcatcaggtcgatcatcgccagaccgatcgcgcgggaggccggctgatcggtgtcgtttgccatcttgccggcaatatgcgccgccggaagcgagtagaagtagttctcgtcgaacggatagtaggtcgaaggtgcggtatagtagtagccgttgtagcaccagcggttggtgccgatcaggctgtagttcgcccagcggctgagcatggacgggtcgctccagtcgatgagcgtctgctgagaagtcagcagcagatagtcgctgtaggtgccctgcgtaagagccgcaacctgtacggagaagcggaagcccgaagctgtccgctcgatcttcagagagccgtttttgcccggaaaatactcgatcatgccgttgtctcgcgcggcataggtcatcggcgtgacgagaatgctgtccacgccgtccacccgcagaaagtacatgccgctcggcagcgtacccgcagtgagcggctgctgtttccacgaggacgctgcggtgtcgtaccagcgaacggtgccggacgtgcccttcatctcaaactgcgcggctgtgtgcgcgggtgcgtccagtacggcggcagagtgtcccatctcaaccgcgcagccctgaccgtccgtgtagcggcgggtcgctcgatggacttcggtcaggtcctgttcggtctcgctgcgcgtcacgtcgcccagtttggtggtgaaggctgtgtaggaatgggtctgcggcggcttcggtgcatcggtttcccgctgctggtaggagaccatcggcgcaaaacgctgcaaaatagtcgccagctgtgcgcgggagaccgtgcgctgcggagacagcgtggtcgcggttgtgccggtgatcagttcctcggcgttggcccactgcatagcggtctgcgcatacggatgaatcgaagaagcatccgtgtagccggagagcgcgctttgtgccgtcacatccagctttttgtattcggcaaagcggtacagcataacggcgaactgctcgcgcgtaagtgaggtgccggggcgaaataccgtgtcgctgtaaccggtgatgatgccgttggacacaccccactgaactgcggtcaggaaggacgcatcctccgcgacatcctgaaaggtaagcactgtgtcagctgcaggcgcgtgctccatgcggtacagcgcctgcaccagacaggcgcgggtcgcaggtgcatctgcagcaaaggtgtattccgaaatgccgtccatcagattggactgtacggcgaattccatggcctgctcggcccagtgcggctttaaatcggaataatcggcggcagcggcgccggtcagcatcgaaagactgagcattacggccgccgcggtatagcgatgttttttcaaaagagtaaacctccgtgattgttttcgcgcagaaaatcatgcgcgtggtttatacactttcacaatttatcattataacaccgcggcagggtgggccgcaatagcaattctttgtaatatcagcagagaattactgcagattctcgatgagtttgcggcaggtatcagcggacaggctgctgtacaggtgatagacgatgtcatcgtgcgtccagaggagcgtgaccgtgccgtttttctcgatcatcgtaaccgggctgccgtgcaaagcaaattcggtaacggatgcgttttctgtgtccacgagcttgtgtgcctccgaagtgtccgtaatccgggtgcaggtcaggtcgagaaaatcggtagtgctctcgtaggtgacggtatagccgttaggtgtgctgtgctcatcggttttgtgcatggtatccggcagatcgaacagaaccggcggtgtgaacgccttgctgtcggtttcggacggcagggccgatgaaaaacgatagtcggtcaggtcgttaaacacgcgcacgacagtattgataagcgatacgcggtatgcctctacgctcatcgcgcagccgaacgaaaccgcagcggaaagcagcagaacagcggccgtgcggcgcgcaagacggaggctccggttaaacgctgcagagtgcttttgtgcacgcaccagacggcgcatttcacgccggaattttcgggagaaacggtgctcgggcagcgcatccggcgtgcaggcttgcagccacagttcgcgcgcttcggcggcctgcgcggacagcatatcgtcagtgatcttcatttacggttcctccatctcgctcagcgctgcgctgagtttttccttggcacgctggatgagcttgcgcacgttcggctcggtcgtatccagaatattcgcaatctccgcgttggaatagccgcagtcgtaccgcaggagcagtaccgagcggtaacgcggcggcagggacgcgatagcggcggccagtgcgtcgcgcgcggcgagacgctcgatctcggcggcaggcgcagctccaatatattcctcggcaagcggcaggacattgcggcgctgcttttcgcggtacaggtcgattgctttgtgctcggtaatagtgacgagcagcgcacgcgttttgtgacaccttggtgaagaaatggtatccagaatttcgatgactttgagaaaagcctgatgcaccacgtcctccgtatcgctgctgttgcacagaatgcggtttgcggtgtagtacatcagatttttgtattcgctgtaaagaatctcgaacttggacttgtccgcatccgagtcgatcattgccagatagagaaacatttttacgccttcctgcctgttattttagcagattatagcatattgtgtccggctgtgcaatccaaagagcggatttgcaggccggtttttctcatgccgcaaaaattcaaaaatttttgcgggagcgtgtcacaaaaccggaaggacattcgtctatatagtatgagcaggacaggagagcaggaaaggagggagtgcatgaacaatcgcaggatatggtttcgattaggcggcgtactggctgtggcagctgtctgcacaggcggtgcggccgttgtctccgaccgtgcgcaggaagcgaaaaatgtacagagggcgttcctcggcgcgatggaaacgcagatgcagatagggtgctatccgtcggagaccggctcaccaatccggagcagggattttcggtggagctgccggtcaatcgggatgccatcactgcgactatgaagaaggaaaacggcgtgtggaaactggactcgattgattcacagatcagtctgtcggctgtcgtaccggcggatgatgaggtttgcagagaacgctatccgtcatttgaaacggcaaggcaggcggcagacagtacagatgaccaggcatacataaaggaggcgcgtttcgcttgaactattttgggctgcaccgtgtggctgctcccgcatgaaaaggatagagcggcggacttgttgtggggacaaatccaccgcaaaacggcagagaaaagtgaaacagtcacagactgaactgctgtgactgttttcgtctgcttgcagaatatacaaaaatttttgaaaaaagttgttgacatttctgagagaatataatatactaaacaagcgctgtaaaaaacgcctctgtagctcagtcggtagagcaggggactgaaaatccccgtgtcggtggttcgattccgcccggaggcaccattattttttaatgagtgccattggcactcattaaaaaataatacctccgtgctgaggaatcgaaagctggctcttggaaatatgccggtggcatatttcaaccagcgtggctttttccgcagaaaaagcgattccgcccggagatgtagcgtcggagcggcaagtaacccatcttcgagtcaaaaaatcgcgttagcgcgaagaaccaaatatgcggctgtagctcatctggtagagcgccaccttgccaaggtggaggtagcgagttcgagcctcgtcagccgctccaaatcaaaggacaccgatgtaatttggtgtttttcttttatccgcagcacactcgcttcctccaccttcgtaaaatcagaggtcggggtgtggatgcgattcgagcctcgtcagccgctctaaaacaaaaaagcaccgatgtattcggtgcttttttgttttacccaaaccgccagcgctgttaattctttgccggtttaccacttcaccatgatagtgcaataaccgctttgcatgaaattccctttatcagaaaatgaaatttatgaaaaaatacaaaattcacgtttgcagcagagaaacaaacgcaaactgcgaaagaacgcttgtgacaccctgtcaaatatgctataatgagcctatatttgaggtaacacagcacaatgaaagctgcggtgctttgcggaaattttacaccctgacttcgttccggtttcacggtaatacagcaagtattaccgcaaaactgcgtacagtcagtatgcaaaatttactcgcaaatcacacttgttcaattatgcggtattaccttgttcgctttacagtttacagataaggagctttcgacgtgaaaaatcgcgagcaaattcgcaatttctccatcattgcgcatattgaccacggcaaatctacgctggcagaccgtctgctggagcagtgcaaggccgtttccgtgcgtgaaatggaggagcagctactcgacaatatggagcttgagcgcgagcgcggcattaccatcaaggcgcgcgctgtccgcatggaatataccgcggataacggcaagacctacgaaatgaatctgatcgacaccccggggcatgtggacttcaactatgaggtttcgcgttctctggcggcgtgtgagggtgcgcttctggttgttgatgcggcacagggtattgaggcgcagaccctcggcaacacctatcttgccattgacgccggtctggaggtcgtgccggtcatcaacaagatcgacctgccggcggcagacgcgccgcgcgtcaagaaggagatcgaggatatcatcggcattccggcagaggactcgcccgaaatttccgcaaaaatgaatatcaacattcacgaggtgctcgagcgtatcgtcactgatattccggcgccggagggcgatgcggatgcgccgctgcgtgcgctcgtgttcgacagccagtacgacccgtacaagggcgttgtcgtttacatgcgcctgcttgacggcaaaatttatccgggcatgaaggtcaaaatgatggccaccggtgccgaatttcaggtgcttgagtgcggctatatgctgccgctcggtctgtctccgcagcaggagctgtgtgccggtgaggtaggctactttacagcctctattaaaaaggtatccgacactcgtgtcggcgataccgttaccggtgtggaaaatccgacgccggaggcgctgcccggctatcgtccggcacgtccgatggtattctgcggtatttacaccgaggacggttccaagtatcccgatctgcgtgacgcacttgaaaaactgcagctcaatgacgcagcgctgtcgtttgagccggaaagctcggtcgcactcggcttcggcttccgctgcggcttccttggtatgctgcacatggagatcattcaggagcggctcgaacgcgagttcgacctcgacctcgtcaccacgctgccgagcgttatctacgaggtcgtcaagaccgacggcacgacccagcgctgcgataatccgcacgattatccgagtccggatgtcatcgaggaggctcgcgagccgtatgtcaaggcgtccatcatgacgccgcaggagtttgtcggcaatatcatgccgatgtgccaggaccgccgcggcatttttaaggatatgcagtatctggactccaatctggtcgagttgcattacgaaatgccgaccggtgagattatttatgactttttcgacgcgctcaaggctcgtaccaaggggtatgcatcgctcgattatgaatttatcgactatcgcaagagcgatcttgtcaaggtcgatatgctgctcaacggcgatcaggtggacgcgctgtcctttatcgcgcaccgcgacaaggcctacggccgtgcccgccgtatctgcgaaaagctgaaggagaatatcccgcgccagctgttcgaggtgccgatccaggcagccatcggcggcaaggtcatcgctcgtgaaaccgtcaaggcgcttcgcaaggacgtactggctaagtgctacggcggcgatatcacccgaaagaagaagctgcttgaaaagcagaaggaaggcaagaagaagatgcgtgcgctcggcacggttcagctgccgaccgaggcttttatggctgtgcttaaactcgatgaggaaaactaacgctgcaacaggcggcaagctgctcggcctctacctgcacatcccgttctgcgtgaaaaagtgcgcgtactgcgatttttattcgatcacggatgcgtcgctcaaagccgcttacacggcggcgctgattcgtgatataaaggcgtacggcgaacgctgttccggttacacggtcgataccgtgtacatcggcggcggcacgccgacctgccttggcgcaggctatctcagcgagattttacaggcggtcggggcatgctttgcaattgcggaaaacgccgaaatcacggtggaatgcaatccggagagcacggatcaagcggtgctggaggccatgcataagcacggcgtcaaccggctctcgtttggcgtgcaggcggcgcacgacaccgagcttaaacgcatcggccgtatccacgactttgcgcaggcacaggcagccgtagaactcgcacgggagtgcggctttaccaacatcagccttgatttgatgtacggcctgccggaccagacacaggcgcagtttctcgactcggtaacgcagtgtttgacgttgcatccgcagcatttgtcgtgctacggactcaaactggagcctgcaacaccgatgggacgtgaaaatccggttctgccggatgacgacacgcaggcagatacctatcttgccatgtgcagactgctcggcaggaacggcttcgagcactatgaaatatcaaatttcgcaaaaccgggttttcgttcccggcataatttcaaatactgggatctttccgactatctcggactgggaccgggcgcccattccttcctgaatggccgccggttcgcgtttgcccgggatatcagggcttatatcagcggtgagagcatcccgcaggacgaggaggaggtctcggacttccggcggcagggcgaatacctgatggtgcgtctgcgtacctcggacggtgcggatatgcacgatctcgaaaaccgataccatgtcagtacggctccttacgagcaggtattccgcatgctggaaaagcacggtcttgccgctcacgagggaacacggtggtatctcaccgaacaggggtttctggtttccaacagcattatcaatgctgtggtggaagccggagaataattgagaacgacggattctcaattttccattattcatttgtttgtgataaattaacatatacgcaaaaatggaggaatcactatgcgcgcagtaatcacagtaacaggcaaggaccgtaccggtatcatcgccaagatttcgaacacgctctatgagcatcaggtcaacatcatcgacatttcgcagaacgtaatggaagatgtatttgcaatggtcatgctggtaaatatcgacaagtgtaccgtagacttcaacacgctcatcgacctgcttgacaaggatggtgaggaactcggcatgaagattcacaccatgcacgaggacatcttcgacgcaatgcacaaaatctgacaaattgacggaatcgagagcaggtaaccgattctcaactctcaatttttcaggaggtttagttaaatgtctatgatcaacacgaaagatattctggaaaccattaagatgatcgaggaggagcacctcgacattcgtaccatcacgatgggcatttcgctgcgcgaccttgcggcggacgacatcaatgtgctggcagacaaggtatacgacaaggtaacacgccgcgcggaaaagctggttgccaccggtgagcagattgagcgcgagcttggtatcccgatcatcaacaagcgtatttcggtaacgccgatcgccatggtcggtgcgacctcctcggcaaacagctatgtaccgctggccaaggcacttgaccgtgccgctgcgaccactggcgtcaacttcgtcggcggcttctcggctctggtgcagaagggttttgccaagggcgatgaaatccttatcaactccattccggaggcaatggcggaaaccaatctggtctgctcgtcggtcaacgttgcgtccaccaaggcgggcgtcaatctggatgccatcggtctgatgggccgcatcatcaagcagaccgcagaactgaccaaggacaacgattccatgggctgctccaagctggtcgtttttgccaacgcggtagacgataacccgttcatggccggtgcgttccacggcatcggtgaaccggagaccgttatcaacgttggcgtttccggtccgggcgttgtgcagtccgcaattcgccgtgcaggtgactgctccatcggcgaggtagctgacgtgatcaagaaaactgcgttcaagatcacccgtatgggccagctggtcggcgcactggcaagccagcgcctgggtgtgccgttcggcatcgttgatctgtctctcgcgccgacgccggcgatcggtgactcggttgcgcgtattctggaggaagttggtctggaggtctgcggcggctgcggcacgaccgcaatcctcgcgatgctgaatgatgccgttaagaagggcggcgttatggcatcctcgagtgtcggtggtctgtccggcgcatttattccggtttccgaggacgagggcatgattgcggcggctcaggcaggcgcactgacccttgagaagctcgaagcaatgactgcggtatgctcggttggtatcgacatggttgctgttccgggtgacaccaccgctgaggtcatctccggcctgatcgcggacgagatcgcaatcggtgttgtcaacaccaagaccactgctgtccgtgttatcccggccatcggcaagggagtcggtgatatggtcgagttcggcggtctgcttggctcggctccgatcatgccgatcaagaccggttctcccgcgaagttcattaaccgcggaggccgtattccggctccgattcagagcctcaagaactaactgcataaagcgcataaaaacagctcagcaatgcctgagctgcttttatgctatgcctgtgagacgaaaagacgcccgctcaaaaaatgagcgggcgtttattgtttttaccggttctcgttgcctttttggcacatggcagtgaaaatcacgcctgcaccggagacaacccctacgcttatccacagcttggatgagccgtcagacaagtgcaccttgaagctgtcagccgctgggatatcattctctgcaatatcagtagccgaaacctcgttatcccaggtttcaccggccggaatcggtccatcgggaatgtcgataatgatcggctcataggaaacctccggaacctcggaatccggacggtttacagataaatcagtctcgttctttgagatctctgaaacgaaagcagcgtccgtctccggagaatcctctgctgcaaaagcgctgatgccgagcatattcagactcaggctggcggtggtcagcagaacaagaaaacgcttgccttttctcttcatgagctctccctcactttcgcatgaaatcagaagcataaatcaatgccgcttcttattatcgaacatagtttatcagacagcagatacagaaagaggatatattttgcgaaatgacagcattttcctgaaaatattttatacaaggcgctaaagcggacaacggacacggaaaaagccgttctgaggcatagaacggctttggagaagttattcccactgcgcccaaacatcgggctggtagccgacagttgcctgacggccgttgcggacaattggcgttttcatcagcgtgccgtcctcgagcagcttttccttcttgtcctcgtcgtaggcgaggtaggcaagcgacgcataactcttgcttttctggtcgagcaggttgtccagtccgccgacagccttcagcacgctgtccagttcacccttggacatgcccttttgcgcaaggtcgatcatctggaatttaatgccgcgctccttgaaccatcgctgcgcttttttggtatcaaaacacttgtttttgccgaaaatctgaatattcatgccgtaatctcctttgctctgctgtttgcattatagcagaactgggagaggaaaacaagggcaataccgcataattgaacaagagcgatttgcgcaaagcgccgcggcagcgcgaccggagcctgcgcaaggaaccgcagctttaattgtgcggtgttgcccaaatcctattgcggtcggcgcaggtgcaaaacgccgcaggtgcgtgtgaacggatacagcagcacgcagacaagtgcggcgcatcggccaatctcacacaggaggagaggcactgcgaagaatacctcgccgtgtcgggcaaaattgccgatggcagccagtccggcggcagtgaacgccggataggggagcagggcagcggtgttagctccaagcagcagcactgtgcgcagcagcaggagtgcgagcaatgcaccgcctgcgctgagtccacgcgacacgcttgcggacagcctggtctccggcagagaaaacgccagtacgaccgatgccggcagcagggagtacagaatgtgccggaattgcggcagcaatgccgctgtcggtgcggaaaagctggcaggcgtaagctgtgtgaatgtcagcacaccggagagcaggagtaccgtaccggcaagccacgcaatcggcagtgcccacatggcacagcggttgagccccattgatgccatgagcaggatgcagactgtcagcagcacaactgtgctgccgcatgagcgtccggtgaacacggtcttctgcaggaaaatgctcatgcgggcgatggatgcaagcagcggaaacagcgaggtcaaggcgagcacccattgtgcaggagccgaatgccgaacacggtcggacagccttgctgctccgataccaaccagtgcacagaccgtacacgcgagtgcagcggcgtatacgctctgcccgtcggcgggaagatacagtaattcgctcatcggcagcagggcaaacagcgccgcacaccaccgcggaaacagccgctcacgcataggcgccaccgccaatctcaccgtctaaaaagcagttcagccgttcgtttttgaacactgccgtgcctgccggtgccgtctgtccgaacgcatccacgcgcaaggccggaagaatggccgtgccgtctgcgtgcagcacatcggtgacgcggtacagcggcatatccggcagaacgccgtcctgcgcggagcggtcaagcagctcgctgagcgcgtacacctcgttgtcgttcgccagcagctcggcggcagagccgtcccgcacgacggctgcccgcaggctgagccgcacatcgttttcacggcaaagatagtccgccagcggaagaatgctctcggaaaccgcatcctcgcttaaaagcagcacctgtgcatggctcaaatacaggtcgcccggcaggatactgcgcaggttgcgcagcgcgtccgtcacatcggttccggtagcggacaggtaagccggtgcggcggtgtcgtccggcgagtcctgccgtaccacctcggcggtcaggcagtacacaccgtttttgcagtcgagcgcaagtgcggataccggtgaaacctctctcgcacagccgcacagcaacagcagcagcggcaggaatctgagcagcttcacgggcgttcctccttcgacgggcgtttgacggcaaagcggtcgcagcgcatgaaaaaccatggatagcgaagccaggtgtcctcgtgctcggcagagatgcgcggcaccagattgagcagatacggtaccgagcacgagtgcatgcggcacagtgctgcgagtgttaatccgagtgcaagaccaacgccgtacagtccccaggaggctgcagcagcgagcagcacgaagcgaagccacagggcagcagtctgcagcttgggcaccatcagaccggtgacacccgcgatagcgactacgataacggtcggtgcggcggcaaatcgcgcggaaactgccgcgtcaccgagcaccagaccgccgacaatgctcatcgtctgtcccatggcaccgggcgttcgcgctccggcttccttgagtgcctcgagcacgaacagcatgagcaaaatctcccatccgatgggaaggggaacgccgcgctgtgcggcggagacagcgaacagcagccgcgcgggcactaattctcggtgatagagcatgagtgcggcgtacatggcgggaaacgtgatcgtgaatacaaatccgatgacacgcaggatgcgcgaaagatttgcctgcagaaagctgatatagtaatcgtcgttggactgaaagcactcctgaaacagaaacggcgctgtgagcgctaccggactgccgtccacgacaatgacgcaccgaccctccagcatacgggaagcggcaacgtccggccgttcggtcgtgccgagtgtcggaaacggcgaccagcggtggtcgcgtatgcgctcggcaagatagttggagtcgagcacactgtcgatatcgagcgcggtcagacgcgtttccagacgcttaaccagactgttttcacacagtccggcgatatagcacaggcacacgttggtgttcgtgcggctgccgacgcgcataaaccggaatttcagccgagggtcgttcacgcggcggcggatgagcgccagattgggcataaagcactcggtgaagccctctcgcgggccggaaagcacgcgctcgttttccggctcggcggtgctgcgcttgtcgaagcccttggtgttgacgagaaccggacgtgcatcgccgtcagtcagtacaatggcgtcgccgtagagaaaggcggcaaataccttgttcatatcggtttccacgcggcattcatcggcctggagcacagcggcggcgagtatatcggcggaaagccgcggctgctcacagcgcaggatcggccgtacaaggctctggttgatggcaagggaatttaccatgccgtcaaagaaaaacagcgcacagcgcagtccgttttgaccgatagcacgccgtatgataagcgtatcgtcgttccggaacagctcctgcatcatgcggatgtttcgttccagatcggcggtaaatgtgatcgtttccatagtttcacccccgaaaataaggatgtacagaaaacgatagtttatgcaggttaattgagaatggataatggaggagtctgcccatagggcggtgattgaataattgcgctgtgcgcgatatcagcgcagcgcggatgaactcgcgcaaggatagcgctaattctcaattctccattttccattttcaattcagcagttcgtcagacaagacctcgccaaataatctgatccctttcagcgcttctgtcatcgtattgcccgacgaacctacctccaccagaaacgcgctgtgcgttgcatgctgattaaaacgctgggtccgcagattaagcggacgcatgagcgtcggataggtgcggttgagccggtactgcagcgatgctgcacggttcaggttctcctgccagtccgggtgatacaggccgccgtcatctgtgccgaccacaagcataagctgtgcagtttcctcgccgtttatcgtgcaggaggtcttgtaggcgcggccgtcatcggtcaggatcgagtcacggtgcacgtcaatgacggttgtgatggatggatattctgccagcgtgtcctcaaccacggcaagcgagcggtcatacgcgccggtgtacacgggcgaatcgaaaatttcgcggatatgtacggcctcaatgccgttgttctcgaggaccttctgcaactcgtcaccgacgcgcactacattataattggtatcggtcgtgcgctcggtctcggtcggtgtatacggaaaagcggcatccggcgtgtagctttcgctgctgtgtgtgtgatagataagcacctgcggcccatctccatcagcggaaaaatgctcgtctgcggccagacagtctgccgcatccacgtcatacgaggtctcgttgttgatggagaccgtggcagccttgtcagcggccgacagcaccggattatcgttctcggtgtcggacgagggcacataggtactctctgcaagcggattttccgcctgctcatcccgcgctgcggcagccgtgcgcggcgtgtacacctcggcggtatcctccggcgaaacgccgaactcgagcgccattgcgcgggtgacaaagccgctgttgcgagccagaccggtcagtgccttttgtgcgatcggctcgccgcctgcccgggaaaaaatcagcagcgacagcgccagacagagggtgatggcggcaggcaggcggacgccgcctctcgatcggaatttctgatgtttacgccgcttcattgcgccatcctccttgctgtttcatgctatctatcatacgccgtacagcgtgcgagtatgcccgaaacctgtcacgagaggtacaggtcgatatcggcaacactgaggtgcggatgcagcgccatgttgactgcgtagccgatcatgcgggagatgtcggcaacctcgcggtcaatgtcgcgcgtggtgatcatcaccggctgagagaggtcgtccagcgcttcgcaggcaggctgcccgagctggctgctgatctcatgtgcgagcgttgcaccgtccaccacggtcggcacgccaacggcaatgacaggcacgctaagggtttgctcgttcagcgcagcccgcgcgttgcctacgccggcacccggcgtaatgccggtatctgccagctgaaccgtacgcagcagccgcgacagccgaccggcggcaagcgcatccacggcgatgacagcggcagggcgcacgcggtcgagcacaccgcagatgacctcgccggtctcgacgccggtctgtccgagcacacccggagccagtgcggaaacgggccgccagtccgcgaaaatagcgggcgactgcgcgaccagatgccgcgtggcaatgacatgatcggcggtctgcggaccgatggcatcgggggttatcatacggttgcccagtccggcgatgagcaccggaccgtcattcggatgcggcagcagctcgcgcagcagcgtgctgagcgccttgcaggcacgcggaaatgcgtcctcctcgcggcggatgagtgcatccaactcaagcgtgagatagcgtccctgcggcttgccgatctcgcgggcggcatcctctgagagaatgcgtacctcgtgtacggcgaagccctcaagcgtgcggtcggactgccggacatgcggcagggcagcggctgttttatggttttcgatcgcctcaacggccagatcggtgcggaaagccatgcgcaatccctccttataaggatagttttttcgaggaaaaagtttttatgcagaaaatgaaaaaaacacttgctttttttgtgagaagatgatagaataatatcactgttgaatagaaaacgaaggaggtgttttcagaatgcccaatattaagtctgcaaagaagcgcgttaaggttaactccgtaaaggcgctgaacaaccagatggctaagagcgagctcaagaccactctgaagaagtttgatgctgcgattgctggcggcgataaggctgaagcaactgctgcttacacgaccgctgtcaaggctgtcgatcaggcggctgccaagcacctcctgcacaagaacaatgcgtccaacaagaagagcaagatgactaccaagctcaacggcatggcgtaagttctggtatagaacatcgaaaccgcaagttaaacttgcggtttttctttttgcatcatttagatatttatcgaaatgtgttgacaaacgcagaaactgtggtatactgaaaacaattagatggccatctaattaacaggatagtgagaagggcggtgaacggaatggacattaccattctgatttgcgcgattgcgctgattttagcggcaatactggtaatctggcaggcaaaagcgcttgcaaggtgcgatttaatttgtaaatcctgcggcacgaagcagaatctgccgtggaagcggctggttttccgcacgcatgtgggaaatgactggcagctgtattgttcggtctgcgggcgcaaaacgtggtttgccgcacgaaagaggggacagtaatggggtttcagcagagctttaaggcactcagcgatccggtgcggcgcgaaattctgtcgctgctgcggcgcggaccgatggcggcgggcgatattgcggcgcacttcgaggtgtcgggtgcaaccatttcgcatcacctgtccgtcctgcgggatgcgggtctggtgctggatgacaagcagggcaagtacatttattatgagttgaatatgtcggttgtggatgagattctcgaatggatcagcgccttgaaaggagatggcaggaatgaaaaaaatcagtagactgcaggtgacggcgtgggtgctgtcgctgctgccggcggcaatgacagcggtgttttacagcaggctgcccgcggaaattcccatgcagtgggatcttgccggccatatgaattacgaaaccagatggcatttgtggatcgtggccgggatggcaccgctgtttgcggttctgttttactttctgccgcggtttgacccgaaaagcaggaactacgacaaattttccgatgcctatgtcgggttccagatcatgatcgacctgttcctgaccgcaatgtgcggtatctgcattgcggaagcactgcgtccgggtacggtcgatgtgccgacagtcgtatgtctgctcgtcagcctgctggtgatgtgcctcggcaacattatgccgaagtttcgcatgaactggtactgcggactcaaaacaccgtggacactgtcgagcgaagctgtctggacgaaaacgcatcgtgtggcgggccgcatgctttttgcggcgggtattatcggtgcggcaggctcgttcgttccaaacgaaattgcaaagtttgtgctggtgcttgcgccaatggcggtggcaacgattatcccgactgtgctgagctggcgatggtaccgcgcagaacagcagtgatagacgaaaaatggactttgaaagcgcggtttgctggaaaaccgcgcttttcttgtataaaaaggttaaaattacagaatggttacaacaaatttagtcatattttaacttgtcaagtggggaacggtgtgctataattttgaagcaagtttacataggtggggaatacaccctatctatcataaccactgagcaaggagaatattatgaaaagaacgcgaaagctggtgaccgttgcggtgctggcggttgcggtggtcgtaagcgcgatcacggcagcctatgcactgagcgcgaacaccgtggagacgtatgcgtatcttcctgaacactcggtttacttttatgatacagcaggagagtacgcgtgggcttccagcgaggttgatacgcttgccgttgcaggcgtgatcaagggcggcggaacccatctgttttatccgggcaacgccattacccgagcggacttcatcgttatgctcgaccgcgcctatggtatgagtgaagcgctcgacaacggtcaggtcaattcgaacggctcatttgtcgatgtgccgagcagcgcctattacagcaaggcggttatcgcggcgaaagccttcggcatagcggcgggcaccgcgaccggtgagtttcagccgcagcagagcatgacccgtcaggacgcaatggtgttcctcaaacgcacgattgaccgcacggcgctcaaactgggcaccggttcggtgagcagcttctcggatgcgagcagaatttccaattacgcgaagccttccgtcagtgcactggtcggtgctaaggtgatcggcggctcgaaaggaaagatcaatccgctttccaaggtaacgcgtgcggagatggcggtgatgctctatcgggcaacgcatttgaccgtgcagggcagcggcgctgtgtatcagagccgcggcgatctggtcaacctgtgtatcggcacgcagaattactgcgatgttgtgatcgagaactatgatccttcggtgacgtataccggtctgatggggtatacggatttccgacgagtcggtggcgttacctacgtttcgttgagcggcaaacgcgcgatcgaccgcacggtaacgtacacgaacggcgtgttcaccttcgcagacggtgagggtacagtgagcattccggcggccgccgattgcgtagctatcgatgtcagtcagccgtaccatcagctgaatgcgccgacaagcaccggcagtacctaccggcattgctatccctccatcgaggacggcacggttactgcaatttattattccaggatataacgaagccaccctgctttcgcagggtggtttttcgttgttaaatgcgtgggcggaaactggagaaccgtcacgttcattctccattttccattaaaaagacacctccgctatgcagaggtgtcttttttatacatttggagatgaatggatttttggagagaattgcaggatttgagaattaaaattactcagaaaccagcggggtggacaggtaacggtcgccggtatcaggcagcagagctacgataaccttgccggcgttctccggacgcttggacagctcaacagcagcccaaagagcagcaccggaggaaatacccacgaacagaccctcgctgtgagcgaactggcgagaggtttcaaatgcatcctcgtttgctacacgaataacttcgtcgtaaaccttggtatcgagtacatccggaacaaagccggcgccgataccctgaatcttatgcgggccgcccttgccggtggacagtaccggggaggtatccggctcaacagctactaccttgacattcgggtcctgatccttcaggtacttgccggtgccggttacggtgccgccggtgcctacgcctgcaacgaagatgtcaaccttgtgaccggactgctcccagatctcgggaccggtggttgcgtagtgtgcagccgggtttgccgggtttacgaactgaccggggatgaagctgttcggggtctccttagccagctcgtttgcctttgcaatcgcaccggacatgcccttcgtgccttcggtcagaaccagctcagcgccgtatgccttcagcatgttgcggcgttcaacgctcatggtttccggcatggtgaggatgatgcggtagccgcgagaggctgcaactgctgccagaccgataccggtgttgccggaggtcggttcgataatggttgcgcccggcttgagcgcgccggacttctcggcctcgttgatcatggcgtttgcgatacgatccttaacggaaccggccggattaaagtactccagctttgcgagaacctgtgcgttagcgccagccttagctgcaaacttttcagccgcatacagcggggtgttgccgatcaggtcggagaagctctttttaatatcagacatgggataaaccgcctttcaaaattaagaaaaattagaatgtgatgttaataaggaatgatgggaaaactcagtcgatgcaacatcgacacattcgccggatcatcattgagatcactctccttaattcactttaatcatatgtgttttgtatgaattaaatatacaaccgaaactcctgtttgtcaataggaattttgaaaaaagtcaaaaaaacttccgcacccggaaaatggtgcggaagctcacgatttaatgattgagatcccagtcgatggggtcgatgccgtgcgcttcgagaaacgcattgcatttggagaagtgcttgcagccgaaaaagccattgtacgccgacagaggagagggatgcacgctttcgagcacaaggtgctgcggtgcggtgatgagtttctttttgctgcgggcattgccgccccagagcagaaagacgatcggctgctcatgctcgttcagcttttcgattatatggtcggtgaaggtcgtccagccgaggtttttatggctgttcgcctgcccgcggcgtacggtcagagtcgtgttcagcatgagcacaccgcgctccgcccacttggtgagcgtgccgtccttgggaggtacaatgccgagatcactctgcagctccttgaagatgttctgcaggctcggaggcggctgaacacccggctgaaccgagaagcaaagtccgtgcgcctgtccgggaccgtgatacgggtcctgcccgagaatgacggccttgaccttggaatacggcgtgtaccgcagagcgttaaagatgttctctgccgccggatagatggtctgctcggcgtattccttttttagccagtagcgaatgcgcttgtaataatcctgctcaaactcaccggcaaggatctcgtcccaatcgttgccaagatgtaccatgctatcactccaccatttcagttgttctaacttttttgtcgttttatgttttataaagtataacatactgactgcgatgtgtcaaagtgcagttttttcgccgcttgtgagcggtgagagtttcacgctctgcggagcgcaactccctcgctcaggttcagcggaaaacctgccgcccggacagggtatattgctaacgcaactcgtgtgccccggtcaaccggtgcagagaaaagacggacgttggagcggcttgatgaccattttttgaataaaccatgaattttgtaaagccctcttgattttttctgactttgggattattatatcaatgttggcactcggtgattgagagtgctaataccaaacaacaaacacagaggtgtatgtaatcatggcaaccaagcagtttaaggcagaatccaagcgcctgctcgatttgatgatcaactccatttatacgcataaggaaatctttctgcgtgagctgatctccaacgcatccgacgcaacggataagctctactataatgcaatgaaggaaggcaagaccggtatcacccgcgacagcttgccgatcgagctgacgctcgacaaggcaaaccgccgctttatcatcgaggaccacggctgcggcatgactgccgaggaaatggagaacaacctcggtacgatcgcgcattccggttcgctggcgttcaagaacgaaaacgaaaagcaggacgacatcgacatcattggtcagttcggcgttggcttctatgcggcatttatggtcgcaaagcatgttgaggtcgtatcccgtgcggcaggcagcgacgaggccaaccgctgggagtccgacggtgcggacggctacacggttgcaccgtgcgaaaaggcggaaaacggcacgaagatcgtgctgaccatcaaggacaatacggagaacgagaattacgatgaatttctcgagccgtaccgcattcagggtctggtaaagaagtattccgattacattcgctacccgatcaagatggatatgacgcgctcccgcatgaaggagaagccggcagatgcaggtgacgactacaagccggagtgggaggagtacaccgagaatgagaccctcaattccatggttccgatctggaagaagtccaagaaggagctgaaggacgaggattacaacagcttctatacgcagaagttctacgattatcagccgccgctgtgccacatccattccagtgtggaaggcgcggtaacgtacacggcaatgctgttcatcccgtctcacgcgccgatggactactacaccaaggattatgagaagggtctgcagctgtactccaacggcgtactcatcatggacaaatgcgcggatctgctgcccgatcatttcagctttgtacacggcatggtcgatacggcagatctgtcgctcaacatctcccgtgagatgctgcagcacgaccgccatttgaaggccattgcgcagagccttgagaagaagatcaagagcgagctgctcaagatgcagaaggataagcgcgaggattatgagaagttctgggcagcattcggccgtcagattaagtacggtgcttatgttgagtacggcgcacacaaggagctgctgcaggatctgctgatgtaccattcctccacggaggacaagctggtatcgctcgcggagtacgcttcccgcatgaaggaagaccagaagtatatctactatgcttgcggcgagactatcgacaagatcaagctgctgccggttatggaaacgctgtccgacaagggctacgaggtgctgtgtatggatgacagcattgatgagttctgcgtcaagatgctcgctaagtacaacgataaggaattcaagtccatcgcggatgcagacctcggtctggacagcgaggacgagaaggaagagatcaaaaagctgagtgaggacaacaaggatgtcctcgaagcgctcggcaaggcgcttgagggcaaggttaagaaggtcgagctgaccagccgcctcaagagccatccgtgctgcctgcgtgccgaaggcccggtaacgctcgagatggagaaggtgctcaaccagcaggctgctgtcaacggcggtcagagtgtacacgcagagcgtgttctggagctgaatgccgagcacccgatctttaagaagctgtgtgcgctgcaggcggaaggctcggataaggtaagcacctatgcggatatcctgtacacgcaggcgctgcttatcgagggtatgccggtggatgatccggtggcttacgcaaatgctgtttgcaatttgctctcctgagatatataataatatagttagtatataatagaccgtatacgcggggataaaagagtgaatgattgatggattgagaatagcgatgcggctcggctgtgtcgatactacattttatttatgaacaaaaccggaaggtgatgaaacatgaagagaatgctgtggatactcaatccgcatgcgggacgcggtgcaatgagcggaaagatcatcggctgcgtaaccgcatttcagcaggcaggatatgatgtgacgatttatatcacgcagggtgcgcaggatgcaacgcgtgttgcgcgggagcgtgcgggtgagttcgaccgcattgtgtgtgcaggcggtgacggtacgctgaacgaggtgattaccggtcttatgcaggcggagacccgtccggttctcggttatgtgcctgccggtacgacaaacgacttcgcgttcagtctgggcatttccaaggtgcccgctgaggcggcggttattgcggcaggcgatacgctgcaggcgctggatattggccgcttcaacgatcgctattttaactatattgcggcgttcggtgcgtttactgaggtctcctatgagacaccgcagcagaccaagaacattttcgggcgtgctgcgtatatcattgagggcattaaggcgctgaccaacatcaaaacctaccacatccgcgtgaacagtgcggaaacgcagatggaggacgatttcatctacggtatggtgacaaacacggtgtcggtcggcggctttaagaccatccggccggatggcgtggcgctggatgacggactgtacgaggtgctgctcatttacccggttgaaaatccgatggagctgcagtggctggcgaatgacctgctgacgcataatatcgaatctaaccgcttcgcgtacttccgcacgtcaaaaatcagtttttcgtccgatgacgaggtgacgtggacgctggacggcgagttcggcggtgcattgcacaatgtgcagattaccaactgcagccgtgcgatcacatttgccaccggcaaggagccggaaggcaaagaatcataagaaaagtcctgcagaatgcgggcgtaaccgtgataaggaacgaatgcagccgtattacggatagccggcggattcaggtgtgcaaggatcacaaacgcaaagacaaccgcccatttccgaaaggaaggggcggttgattttttgctgtttatcggaagcaaacttattcaatttcatagacgaggtggcaatcttcgtatcggcagagcccgggatcgtagaaaaaacggcgtgactttcacggtcacaccgttctttgcgacacaataattacttgtcacgattcagtgtcagctttgcgggattttttatacgctgggtgcaagcagaatgggctgaagctgtctgccgttcatggctgcgtcaatgacagcgggaatcagcgtcatatctgcgataagcgagcgcggcttgctgtgcggcgcatcctgccggagcggcacgaaatagtaatgccggcgattcagcagcgtgccgagattagcggcgctgccggacagaccgtcgttggtagagaccgccagcacgaccggacgttctccgcgcagatggcttttgaccgccatggttgcaggcgtgtccgtcagaccgtgcgccagtctggcgagcgtattgcccgtgcagggagcaacgatcagtatatcaaacagcgccttcggtccaatcggctcggcagaaacaatgctgtcgataggggagacgccggtgagtgcggtcagctcctcgcgccagtgcgcggctgtgccaaagcgggtgtcgagtgtaccggcgctgtcggacagaatcggcgtgaccgtgtcgccgcgctcgatgagtgcttgtataaccggcatgaccttggaaaaggtacagaacgaaccggtcagtacaaagccaatgcggagtttgctcataagatgccctcctcgtgcagaatggtgtccacggtatcgaataccgcgcgtgcagcgctgagcggtgctaccttgcccggaagagacagtgcgtgcagcacgcggcagccatccggaagcagggtatcggcggcaacaccgcccggcagagatgcaagatcaatgatgaagcagggcggtttcatgtcggatagcacctcggttgtcaggatcggagcgggtacggtgttgaaaatcaggtcaaaaccggcaaggtgaccggcgagcctgcgtgtatccagtgcgtgcagtcctgcggcggcgatgcgtgcgaaatcacgcgtacagcgtgcggagactgtaacctgtgcatcgagagcgtacaatttgcgtgcaagaagcatgccgatccgtccggcaccaatcaccagacagcgtgcattttgcagcgtgaacgcagtttgctccatcgcgagctgaagtgctccctcgcaggtagggaaggcgttagcggtttggcgcataaacgggtttgccttcacatagactgcaagcgaaggagggatagccatgaaactgaccgaacaggagcaggctgctgtttcgcgcggcatgatcgagggcctgctccgcgctttgcacgcggaaggcgtgctgccgcccgagcggctggagctggtgctcgagctgctgtgcgcaggccactgacatgctgcgcgtggccgcctattgccgcgtttccacctcgcaggaggaccagagaaactcactggagaatcagcggcgatatttttcggagtacatcagccgtcagccggactgggagcttgtggaggtttatgcggacgagggtctgtccggcacctcgtccgaccggcctgcctttcggcgcatgctggcagcggcagcagaagagaaaattgacctgattttaaccaaagaggtctcacgctttgcccgaaatacggttgacacgctcgcgtacacgaggctgctgcgccgtcagggagtcggtattgtattcattggagatcatatcgacacccgccagaatgacggtgaattccggcttaccataatggcaagcgtagcgcaggaggagagccgcaaaatctctgagcgcgtcaagtgggggcagcagcgctcgatggagcgcggtgtggtgttcggatgcgataatatctacgggttttccctgcagggtggggaattgacagtgaattccgagcaggcggcagtcgtccgcgaggtgtaccgccgtttcttgatggacggcaaaggcacttacatcatcgcacgggagctgaccgccgagggcatcccgccgccaagcggaaaaggaaaatcgtggtcgtctacgatggtgctgcggctgctccggggcgagaaatactgcggcgatcttctgcagcgcaaaagctgcacgccggattttctcgatcatcgcaaggtgaaaaatgaggggcagtcaccgcaggtctatctgcgggatcatcacgaggcgattgtgccgcgctcgatgttcgaggctgtccggcgggaactcgaccgccggcaggcaaaccacaaagccggcagccgaccctccgcgcggtactggtgctctggaaaagtggtctgcggacggtgcggcagtcggtttgtgccgcgcaggggcgcacaggcggacggcggtctgcgatgggtgtgcgggaaacgggtgcagcacggcgtggcagcgtgtgcggctccggcagttgggaatcgaattttgctggactgcatgaagcaaattacacaggatttaccaatcaacatagaggtggtattgcggcagaccttgcgcgcgatacctgatctcacacgcaccgaaagacagcaattctgtacaattttacgaaaaaagctgtacagtgaaacggtttacagcgcactgctcgatcatatcactgtaacgggggagggcttgactgtacatctgcacggcgtgtccgaaccgctgtatttcgacctttcgagcagagaaaaaccgtccgtgcagcgcacggacggctgaacactattcgcttttctttccacgttcgtcgtaatcatcgaggaacgagtggagcacgccgccggtcttgtaaccgggcatcatgtccagatttaccgagtggatactgttgaagatgctgcgctcgatattcgggttgtcgcggcgcagacggcgcagcagaatcttgacctcctgccgcttggaaccgccgccgccgttgtcgcacatcgtgcagttttcggtgaagcggcacgcgcactggataaattcgaggtcgttatactgcttccacgcgaggatatcctcctcgtgaatgcagtacagcggacgaatcagctccatgcctgcaaagttggtgctgtgcagcttgggcagcatggcctgcatctgcgagccatagaacatactcatgacggtggtttcgatgacatcgttgaaatggtggccgagcgcgatcttgttgcagccaagctcctgcgccttgctatacagatagccgcggcgcatgcgcgcacacaggtagcacgggtttttctcgctgttgttagcaaccgcgaaaacatcggtctcgaacacggtgatcgggatatgcagcagtgcggcgttgctctcaattttattgcggttgatctcgttgtagccggggtccataacgaggaaaactacctcaaacggcacctcgctgtaccgctggagcagctgcatcagcttggccatcagcatggaatccttgccgccggagatacacacggcaatcttgtcgcccggctgaatcagctgatactgacggaccgccagtgtaaacggattccagatggtcttgcggaattttttgatgatactgcgctcgatcagctcgtgcggctgtaaatctcgtttcataatgatgctccctgtattacttgactaactcgtgatagcacgcgtcgaaaacggacagaaattcgtcgatttccgcgtccgtggtaaggtggctcaggctgatgcgccatgaggacagtgcatttctgcgatcacggctgacagcaaacactgcacgggacggcagaccgtctgccgagcaggcggatttgaccgatacgcacacgcctttttcggacagcgcgcgctgaaatacagtgcctttcacatttttgacgctcagattgaggatatgcggcacggcgtgctccggactgttgatatgcaccgccggatacgccgcaagtgccttccgaagtcgttcgctgtggcgctgaacgacagcacagcggctttcgcgttcatcgcatgccagctgcagtgccagcgcagatgaagccgccagaccgagtgcaggcgtgccgctgcggtacagggtcgtgctggcaccgccgttcatctgcggctcgagcggcatacggctgcgcttgagcagcacgccgctcccgcagataccgccaaacttgtgcggcgcaaagctcagcgtgtcgataccggaaaagtccaccgggatgcgcccgatggcctgtgtcgcatcaacgtgcagacggcagttcggatggtcagccagcagcgctgcgatttcgtttaccggctgaatggtgccaagctcgctgtccaccgcgcagatggcaacgagaacggtatccggacgcagaagctcgcgcacttcctccgggtcaaccgtgccgtcccgtccgatggagagcaggtcgatctcccagccgcgctcctgcagggcggtcaggctgccgctgaccgaggaatgctcgagcggtgtggagatgatatgcttgccgatatgccgtgacgcctgtgcgatgcccttgatggcgaggttgttcgcctcggtcgcacccgaggtaaagatgacctcggcaggggacgcgccggtcagcgccgcaatctgctcggtgacgcgcgccatttcctcacgggcggtcttgcccgccgcgtgtaccgagtttgggttggccgggaaccggcgttccatatcgcagaatcgctcgagcactgccggatcggcgggtgcatgggcggcataatcgagataaatcatagcatggactcctcaaaataaggttaacggctataatcatagcatttttataggaaaaagtcaagatggacagaaaaagactgctgtctccgatgaaacagcagtcttttgttttacttcattgcagggtcggtcacaccgttcgcctcaaacgcgcggatgcggtccagacaggtgccgcacttgccgcacggcttgtcgccgccctcgtagcagctccatgtgagctgatagggaacctgcagccgcagaccttcggcaacgatctgcgccttgttccaacgcacgaacggagcctcgatgcggacatcaccgcccgagccgagtacgatggagtggttcatcgcatttacgaattcctcgctgcagtcgggataggcattgccggcggcatcgtcgtgatgtgcaccgtagtaaatcacgctgcagttcttggacagcgcaacgcttgctgccgccgacaggaacaggccgttgcggaacggcacataggtcgtaaccggcttgccgccgcgctgcgccagctgctcggcgtaggattcctcggggatgtcctcggtcgagtgggaaagcagcgagcagtcgctgtatgcgaacaccggcgtcaggtcgagagatgtgccctcgatgccgtagtattcgagaaccgccttcgcagcctggatctccttaacgtgcttctgaccgtagtaaatggacagcgcacacacattctccttgccgtgcttctcgatggcaagcgcaagacaggtcgtgctgtccacgccgccgctgcacaggaccattgccttttcgctcatcggttgtccaccttctccgggtacagatcgtggtgggtgagacgctcgaatgcaacctcctcccagcgggtgccgggcttgccgtagttgcagtacgggtcgatcgagatgccgccgcgcggtgtaaatttgccccagacctcaatgtacttcggttccatcaggcggatgaggtccttcataatgatgtttacgcagtcctcatggaaatcgccgtggttgcggaagctgaacagatacagtttaagcgacttgctctctaccatgcgctcgccgggcacataggagatatagatagtagcaaagtccggctggccggtcatcgggcacaggctggtgaactccgggcagttgaacttgacaaaatagtcgttgtccggatgcttgttcgggaaagtctccagcatttcgggcgcgtagtccgagggatacttgttcttctggctgcccagcagagtgacgccgttcagttcttctttatttcttccggtcatggttgcattctccttacatttaattaggccttagttgccttgggatacagtgcacgctgcagtacgttcaccagaacgacaccgcagaccgcaggtacggactgaccgatgcacaggctggtggcgagtacagaatacggaacgtgcagcagatagctcagatagctcggtacgccgagaccgggcacaaggatgatcgggaggatcatcagccagcggctccagcccttgcggcggatgagcacgatgatcgcggtaacgatgataccgacgaagcagcctccgaaccagtccagcagaccgagtccgccgaacagaaagttggcaatgaaattagcgaaaccaagcggcaaaaccaggaacggaaacaggtaagcgagcgcatacagagccgttgcaatgcggatctggtacgcaccgaaagagaagctctgcgtaaagtacagcacaacaacgtaaagtgccatcaccatagcagaaacggtcagtttttgaaccttgctcatgttttcttttaccatatttcgttcacctccaaataatgcacacaacaacgttgattgagaaacgtaaagtttttctgtttcgttgtccctagttttgttttacgacaggatggtttcgaactgtcattccatatccggaagcaaagtgccgaacggcacaaacgatagtatagcgtatttttaccgtttatgcaagtgcaaaagcaccaaaatgcggttttgatagagagattatgcggtttcaccaagaagcgcgaaatccctgcccgacagagagaaaaccggacattcgacagaaaaaatgcggtcttgtcgaaaattatcgataaatatgcgggaaaaagcagggatatccgcttgcgcggacgcgctgaatatgtaaaaataagatgtaatccataaatcggcataagatagagaaagccgggggaaagcagtaaatgaagatcaaacaaggcaaaatgcgtattttactggcgtgtgcggacgagtctctgctgcaacagacaaaacggcttatgcaggcgagcaatgagctggagcttgtcggctgtacgtcgaacggcacgaaggcgtgggaaatgattcgacaaaaaacgccggatatggtcgtgctggataccgacctgccgtatgcagacggctttgccgttgcgtcatggatgagacagaataagatgtgggatacgagcattatcctgctcagctcgttcatcggcggccagacctatgtggagtgcagcctgctgcacattaacgtgctgctgcgtaagccaatctgcgcggatgcactgtatgagcgcatcaagctggcggtcacctgtaccagtcgtggagacacggtggagcagcggctggcccagatcctgcgtgagctgggtatgcgcgagcagacgatcggctatcagtgtgcattgctgaccgtgtgcctgtatcgggagaccaacggtgccagcatcaccaagatcatttatcacagtgtcgcgcagcagatgaacagcgaaggcagtaatgtggagcgtaatatgcgctacgccgttcaccgcgcatgggataagtgtgataaagccgtgcttgccaggtatttcggtgaagcgcgtgcacaggataaggagccgccgagcaaccgcgaattctgtgcggctctcgtggagtatctccggcaggaagcctgccgcctgtaaccggacagcctgtgctttttgcaaatgcggcaggtaccgcgttgcggatcgccagctcctcgcgggataagtagtcgatgagtgtcagtccgttctgcaccgcgcgggcgtgtacggaaaaaggcacggcaccggccagcgtcagtgttccggcgggaatggcatcgagtacatcgccgatggtgtgctgtgcattggcaagcggcgcgttcaggctgccgtcccccatctgcaccggcataggcagaatgaccgcgcgtgcatcggcaaggcacgcctgcaggtcgctggcagcggtgcagcctgcggcggggcggcgctcgagtgcaaacgtgcgcacggtgtggcctgcttcgtgcagcagctcggctaaatacgcctgacgcacatcgccgccgacgacggcgagagtcgtcgattgattcataagcaaaaacctcctttgcgccattctatgccggatgcaaaagaggagtgaaaagagaacatccgctctttgtacaaactgagagcggatgtttttgtatagattactggttgagtacctcgaacagcgtgtcgcatgcgccggtgagcgactgcgcaggaccgtctgcggtgatctcataggtgttttcgcagccgatgaggccgacacccggaatcgcaatcttcggctcaacggcaagcgtcatgccggactcgagcggagccgagaagcctttggcgagaaccggtgtttcgtccattgtcagaccgatggagtggccgaggaacttgcagccgttcatgaagccttcgcggaacgcaggatcgacgagagagaggatcttctcgtaaatctcagccggaacggcaccggcacgcaggagagatgcggtttcgttctccagtgcaatgcactgctcgcgtgccgcacggatcacgccgctctgcggatgcttgtccagctcgccgtagtagaacgtgatgctcttatcggtatggtagccgcgcaagccgcacggaatgtccagcaggacggtatcgccttcgtgcagcttgcgctcggacgagccgatggacttcattgcggtcgaggtgccgatacagccggagggactgtccagtgcggtgggacacaggctgttttcgctgaagctggcaatgccgagcacgtcctcggctgccggctgattgtagcgcgagatacccatgccgccgcgatccacgatggcggtgcagatctcgctgcacaggcgtgcttcgctgacgccttcgcgcaggaacgccggagcaagttcctcgatgacatagcggtgcagtctgccggattcgcgcatacagtcgagttcatacgcgctcttgaccgagcgcagcgcgctgagcacaccgtccatcggcttgggtgcaaacggcagatgcttgttcagcatggagagcttttgcagcgtcatggtctttgcggcaacgtagacggtctccggaatatccggatagacctccttgatgccgcggaagctgcccatcggacggatgtctgcaaaggcggattcgtcctttgcaacatcaaacgagcggcggacgaacagcgtagcctgatcgggtgtcacgacaagtgcgccatcctgcatggtgccggtgaagtagtacatgtcgagcgtgttgtcgagcagaagcatggaccacgcagggtccttctcggtcatggcacagcgcagacggtcgagccgcgtgttcagttcggcggcgggcacggaaatatggggcatggatgatcctcctgtatgattaacggtggtttacaaaaatgttacttttagtgtagcacatatttaaccggagagcaacgcagacgcgttgactttttataccttgtgcgatatgattatagtctatggaaggactgcgttgtgcagggaagggagcgattatgatgcgcagaaaagtaggcaagctgctgggcgaccgacgcgttgtcggcggattcctgctgctgattcagcttgcaatcgttatgttcggcgtaagctgggcaagtacggaatatcactggctgacaccggcactgaccgtgctgagcgttatcattgtcatctggctggtgcgtaagtacgacaacccgatgtacaagatcacatggatactggttattgtgctgctgccgctgttcggcggcttgttttatctgttctggggcaatacgccgctcaatcgggcgcgtacccagcatcagtacgagccgaaaccgccggatttcaccgactatatgcgcacgcctgctacaaaggagctgatcgagcagcatccgcgtcatgcagcacgcgcccgttacatcgagacgctggacggtatgccggtgtggaccaacacggagacgaaatatttccgtgtcggcgaggaaatgttcgactccatgtgcgaggaactgcgccgcgcacagaagttcatttttctggagtatttcatcatcgaagaaggcatcatgtgggatactatccttgatatcctgcgggagaaggcggccgccggactggatgtgcgcgtgctgtacgacgacgttggttcgatctgcacgctgccgaaagactacgaccgctatctgatgagcctcggcattcatgcggtgcgctttaaccgctttatcccgacgctgaacacctatctcaactaccgcaaccatcgcaagatgacgattattgacggcaatgttggttatatgggcggtatcaatctggcggatgagtatatcaacaaaaaggtacgcttcggctactggaaggacaccggtatcatgctgcgaggtgagggaacagccaatatgaccgctctgttcctgcagatgtgggagtatgtcaccggcgaggacatgccgccgctcgaaaactatctgccgaccgccaagctgccggcagacggctatgtgcagccgtttgcggattcaccgctcgacgacatcaatatcggtgaatccacctacctgcagatcatccataacgcgcgaaagtacgtctatatcaccacgccgtatcttgtactggacaacgagatgattacggcgctgaccattgcggcgcagtccggcgtagacgtgcgcatcctgacgccgggcatcccggataaaaagctggtgtacatgatcacacgttcgtactatcagcagctgcaccgagcgggtgtgaagatttatgagtaccgaccgggctttctgcacgcgaaaaccatcgtgtccgacgatgatacggcggtggtcggtacgatcaacatggatttccgctcgttcttcctgcactttgagtgtgcgacctgcttctacaacagctcggtcgttgccgccgttaagcaggacattatggagaccatcaatgtcagccgccggattgatgacgaatggctgcgccgaatgccgtggattcggtcgatcacggcaagtgtgctgcgtctgttcgcgccgctgctataatgagaggagcgtggttgaatggaccgaccggagcagacactttccgctgtgctggatgcgggagagctgctgctgacctcaggtgctgaggcagcccgcgtagaggacaccatgcgccgtctggcacgcgcctacggttttgtacgagcggatgtgctgaccatcacggccagcatggcagtaacggtacgaacggcggacgagcaggtgatcacgcagacgcgccgcattctgcggcgcggaaccgacatgcgctgcattgaggcggtcaacgagttgtcgcgcgaggtatgtgtgaatcctgttccgccggaggaattgcacgcacggctggaggcgatacgcaccgcaccggataagctgcgctgccggctgccgctggcgtatctgatcacgtcaggctcgttcgctgtgttcttcggcggcacctggagagacggcgctgccgccatgctgtgcagcgtgctgttgtatgtcatcggcgtgctcggtgatcggatttcgctgcagccgctcgtgctgaccatggtcagctcggcggcgatgtgcgcagcagcgactctcacggtaaaaaccggcatgggacagaatctggattatatcattatcggcaacatcatgctgctgattccgggcattccgttcgtcaattccatgcgcgatattttcgtgggcgacaccatcaccggactgctcagtgcatttgaagcggttttgcgagcgcttgccatcgcggcaggctgcgcactcgtgctcatgcagactgggggcggtgccgtatgacgggtgaaatccttctgcagattgtcatggcgatgatcggtgcgctcggcttcggactgctgtttcatatttccggcagccgtctgatcacgatcatgctgggtgctgcggtaaactggggtgtatacctgctggcgatgcagtggtatgataaccgcgtgactgcgttttttgtctctacgctggcaacggctgcactggccgagctgctcgcgcgattgctcaaagcgcctgtcatcacgctgctcgtgcctatgctggtgccgctgattccgggcggcgacctgtattacacgacgcttgcgctcgtgcagggcgacacagcaggctttgctcgatacggtacgctgttcatcgaggaggcgggcgcgatggcgttcggcgtcatccttgtggcgtgcctggtgcagactctcggcaagctgtggctgctgcacagcgaaagaaaataaagaaagcgttctgtaagaggctgtcgcgaaactgcagtttcgccgacaagcaggaacggaccgtgggccgttccaaagtcgtccgaaagttcctatacagaaactttctccctccagaagtataaaaaaccgaacgccatccttgcgcggcttcttggccgcgctgcgtggcacatgtccccggatttttggaatttgcatggcaaattctattgaaacacgcgctaccgcgcgataggataaaattggtttactacaaactgagcgttctgtaaatttcatacagaacgcttttgtgctgcttacagcaggtgaattgtcagatataacgcacagagcagaatcgcgatccacacagtggcgaaaattacattgtacactacccgcgcaagcggcagacgtgcctgccgcagagcctttcccagtacatccgggtcaccgagtgcgcgcagcacctgacgcacagcctgctcctgtgtgagactgccgcggcagcgcagctcctccgcgcggctgagaatatggtcggttagctcccgccgaacgcgggcacggtaaggcggccacaggagatgccggcacacgcggtgcaggtacggcacaatcagcttatttggtgacacaggcgccacctccgattggcttgcggcaggttttccactgttcccggcagcaggtgagcgttttcacgccctgacgggtcagtcggtaaaaccggtgcgtgccgtcctcggtctgccgttcacaggagcggacatcgccgcgtgcctcaagtccgtgcagcaggggatacaggcggctttcgcggatggcaaacgcgcagtctgagcggcattccacctcatgcagcagctgaaaaccggtcttgtccgcctcctcaagcagagaaagtacaagcagagctgcgctgtcgtaaaaggcagcgtctttttgtcctcgcggcatggagatcccctcctttatatattcagtataaccgttcgcaaggggtgcgtcaaattattttacacagattttacgattgcagcgcttgcgtttgtatgcggaatagggtattattaacaagtatatctgtgtgagtattcgctgtttatcatagaacacttgtcaggaggaaaaaatcgtgttttcatcgttattcaactggctgatgggcgcaggccgtgaactggcggttgtgctcatctccatggttccgctggtagaattgcgcggtgcggtcccgctgggcgcggtcgcaggcgtgccggcgatcgagctgatcccgctggctgtgatcggcaatatgatcccgatcccgtttttactgttcttcggcgaaaagctgctggactgggtgtgctcgctcggcccgctttccggctttgccaccaagtaccgtgaaaagctgctcggaaagaccggtcaggtcacccggtatgaacggctgggtctgttcctttttgtggcgatcccgctgccgggcaccggagcatggtcgggtgcattgatcgcaacgctgctcaaaatgccgaaaaccaaggcgctgacttcgattctgtgcggcgtaattgttgcaggcttcattatgctgctcggttctcagggtgtaattggcgttgcacatttgttttaacagataacagccattcccgtgggaatggctgttatcttttgcagcagtgaaagaaaaatacccttttcggaaaattcctcttgccaaccggtgcgatttacgatataataactatgttatgccggtgtgatggaattggtagacgtagtggactcaaaatccaccgctggcgacagcgtaccggttcgagtccggtcaccggcaccatcaagcgcctcggttccttggaatacggggcgctcacaatactatccgggtgtagcgcagttggtagcgcgcctgctttgggagcaggatgccgcaggttcgaatcctgtcactcggaccaaactttatgccgcttgaacattgcgtttgagcggcattttcgtcattataatatacttttgacgctatatagtacagatgaggttttcacttaaaaatccagttaataggagattttagggcgtttaatggcattgggtgtgtcacttagtgtgtcacctgcaaatgaaaagagagcgaggaacaacatgaaactgacccatttggatgaaaacggtgcagcgcacatggtgaacatcggcgcaaagccggtcacgcagcgcgaagctgtggcgcagtccgtgctgaccatgcagccggagacgctgcgcatgatccttgacggcacagcgcccaagggcgatgtgttcgcgtgcgcgcgcatcgcgggcattatggcggccaagcggacggcagagctgatcccgatgtgtcatccaatcccgatcgagagcgtggacatcgccattgaggctgtctcggagacgcaggtgcgcgttgtcagcacgctgcgctgctcgcacaagaccggcattgagatggaagcactcacggcggcctctgttgccgcgctgaccgtctacgatatgtgcaaggcggtggaccgcggtatgcgtattgatgagacgctgctgctgcacaagaccggcggcaagagcggcgattatcacgcggaaggagcggcggcacgatgactttgctggaacagctgcaggctgccgcagaaaatgcgcgcaagggacttccggcggcgctgaccatcgacgcggacggtgtacagtatacgcgcaatttcatgccgcaggaacgcctgattctgctcggcggcggcacgatcgcgcagccgctttgccgctatgcggccgatctcggttttgaactggtcgtggcggacgaccggccgtcctttgccaactatccgcgctttccggaagcaaagcagattgtatgtgatctgtttccggcggcaatcgagaaaatcggcatccgagagagcgattacgttgccgttatcacgcgtgggcatcgttatgatgcggactgcctgcgggagcttctgcgcggcatcatgccgcgctatctcggcatgatcgggtcgaagcggcgcacggtcggtctgctgaacatgcttgaggaagaaggcttctctcgggcagatctcgaccgcattcatacgcccatcggtctggacattggtgcgctgaccgtcaaggagatcgcgatttctgtcgtggcagagctgatcgcggaacgccgccgcacgaccgaccgccgttccaagagcagcattctcactgcagaggatatcgacctgccgctgctggaaaccgctgcacgcggtgatattccaaaaacgctcatgctcgtgtacgagaccagcggttccacgccggtaaaatccggctcgtacatggtggttgatgccaatacggctactgcgggcaccatcggcggcggctgcagtgagagcgccgttatgcggcaggcgtattacttgatcggcaccggcgagcacaagtgcgtcaccatcgacatgagcaacgacattgctgcgcaggaaggtatggtttgcggcgggcagatgaaggtgctgctggcggatttgggtacgaaaaaaatcgacataaagtgaaaaaagttgtcgaaaaatactgggataaaatgtcatgttctctctggtattcatagatctaaaatggtataataaggataaaaagtaaagcaggggaagccatgagactcaaaagacggattttcggtgtatttgcggcagcactggcgggtgtgctgctgtgcggatgtacggctgccgaggatatgcaggagcaccgggcggaaacaccgataacgatcaaggtgggcagcgacaactatccgccgtttaattataccgatgaaaacggcaatccggcaggcgtggatgtggatttggctaaggaatccttcggacggctggggtatgcagtatccttcgtcggcattgactgggaagaaaagaagaaactggttgaacatggggatattgactgtatctggggatgtttttccattgatgggcgtgagaacgaatacaactggactgaaccgtatatgatcagccgccaggtggttgcggtcaaccgcagcagcgatatttaccggctgagcgatctggagggcaagaccattgccgtgcagtccaccaccaagccggagagcattttcctcgagcgaacggacagccgcattccgcttgtgcgtgaagtatacagtctggaggatcgcgaacttctctacacctctctcggcaagggctatgtggatgcaatcgcggcgcacgaaaccgctattcggcagtacatgaaggattatgatgcggattaccgtattctggacgaaagcattctcacgacaggaatcggtgtggcgtttgcaaaaaacgatacgcgcggactgagcgaacagctttcccgggttttcgaggaaatgcgtgcagacggtacgactcgaacgatcataggcaggtatctgtccgatccggataaatatttggaggtggactgtgctgcagattaaaaagggcaaagccacacgccggtacgaacggattgcggctgcaatcggcgccgtgctggtcatcgtggtcggctttaacacggtgcgtgcggagagcgcgcagacacgggaacagctcggcaatacgatagattatgtgaaggagcagtgcacgacctatacacgctacaatgctgcagctgttaccaaaagcctgatgcgtatcatggacaacgcacagcaggtaaaccgcaatatcggctatgaaggctcggctgtagatgaagaccggcttcggttctatgcgcaggaacagcggctgaccggcattattctgctgggcacagatggaagcgtgcagtgcgagtataacggtgatctgctgaattttcagacactgcaggagtatatagagcgggacacagtactcgatgtggtcaggtatccgcagaagacctatgcttcgcggattgacctgccggacggctcctatgtggatatttcggcatacggccgtacagatgtgcccggtgtgatcgttgcgtactatcacaccactgcggagtatgcacgcaattatacgctgaccatacagggctcgcttgcgggctataacaccagggacgacggtgtgattgtggtggcaaacggcgaccgcattatcgcgtccaacgatgaagagctggctgataccaaggtggaggacagccgtattctgcagcagatcaaggcgaatctttcgtccgccgcggtcgggcatttcaagtgcgatggcagcatctatttcggcggtctggaccgcagccgcgattactatatctacgcctatgtatccgaccgcatggtagcgactgatatggtcaaaaatatgatggcggcgctgatcatctatctgttcatgctgaccgcgattcagatgttccgcagacgttccgcgcgggaatatctggccgagcagggacggcgcgagcgggaattccgtgagcagctgatggaatccgctgaaaaggccgagcaggccaaccgcgctaagaccgagtttctgcagcgcatgagccacgatatccgcacgccgattaacggcattcgcggtatgattgagattgcgaattactacaaggacgatccggacaagcagaccgagtgccggaagaaaatatgggatgcctccggtctgctgctcgagctggtaaatgaggtactggacatgggcaagctggaatccggcgagatcatgctggaggaacgcgagtttgacctcaaggaactgctggacagcgttggcatggtggtggataagcaggcgcgggagcggggcattacgataataacggatggctatccggttgagcaccgctgcctgatcggcagtccgctgcacctgcggcggctgctgatgaatatcatcagcaatgcggtcaagtacaaccgcatgggcggtgaaatcaggctgggatgctgcgaaaagccgagtgcggatccggagactgcacagattgaattcacctgtgcggataccggtatcggcatgagcgaagagtttcagaagcatgtatttgagccgtttgcacaggagcggaatacggctcgatcggaatacggcggtaccggtctgggtatgccgattgcgaaaagtctggcggagaaaatgggcggcacgctgtcctttgtcagcaggcagggcgtaggcacgacgtttacgctgtcgctgccgttccgcatctgccatgcaccggagaagcggaacaagccgaaacgcctgctgcagaccagctctattgccggactgcatgtgctggttgcggaagataacaagatgaatatggagattgctgagtttgtactcaatgtggaagaagccttcatcatcaaggcagtgaatggagaggaggcggtacgcatttttgccgattccaggccgggagaaattgatgcgattttaatggatgtgatgatgccggtgatggacggtctggaagcgacgcggcgtattcgtgcgatgaagcgtccggatgcgagaaccattccaatcatcgccatgacagcaaacgctttcgcagaggaccgtcagcgtgcctttgctgcgggcatggatatgcatattgcaaagccgctggaaggctcggagatggtggaaacgctggagcggtttgtcaaatcctcgcggaaataggagcagaagcgcagaaaggatactatataaaggaaagtcagccaaaaacggctgacttttcctgtatagtgcagttccgctgcccgcagcatacacacagcggaactattcggcaggaggggaaactcacatcagccgttccttcgcaagcaggtgggcgtaatgctgtttggcgcggctcaagcgagcacggctggcctcgtggctgatatgcagatattcggcaatgtccacacagttcagattcaactgataccgcagatatagaatctccttatccgtgcgggataattcattcggcagcaggtcgagcatagaaagggacgccggttcgcagccaagattctgaacgctgtccagcggcacctgctcataccggctctgccgtttgtactcatcaagcgcgagattggtcagcacggtgtgcagccagccgggcaggttcgggtgctggcgcacccggtcaaaatgcgtcagcaggatagtaaacgcctcgtttgtcagctcctctgctgtaaacgggttgtgtgcaatgcggatggccgcatacagcagccgcttgtaattcctggtcgtataattgagaaaacagctccttgtcctgtgccgtcatagatcgttcacctgattcctatcgggttatgttatgcacgatacccgttttcaagggggaaatcaatagcgcgttcctgattggtcactttgcgttcccgctctgcagccggacgtccatcaatctgcggtataatagaagcggggcagcaggagacagaacgctttgtgaaatattgtctgctgtgctgctttatggtatagttagttcagaacacaacagggaggagcactcatgcgcattatactgtgcgatgacgataccgcattcacgcaggtctttgaaaaacgcctgctgaccgttttcaaaaaatacggaatcacaccggagatcgtgtccgcgcacacgggcgtggaagccttgcgcgagattacacgcaggccgacggatgtgctgtttttagatattgatatgcctgaaaaagacggcttttcggtcgcggaagagctgtcagccatgccgtcgaagcctcttatcattttcctgtccggcatggaagatctggtgtatcagtcgtttgcgtttcagccgttctggtttctccgtaaaacgcatctggaggagctgccgcaggtaatcgagaaaatgctgcagattctcaacagccgtcagattcactacacggttacgatgaacggcagcagcacccgcattccaatcacggagattgcgtattttgagagccagggacattatatcgttgtgcactacaacgagaaatccctgcggttcaaggcacgcatgagcgatatcgaaacggcactcagcaaatactttttcgtgcgctgccacgttggctatctgctgaactgccggtttgttcaaatctgcagccggacaagcgtcaccttgtcggacggaacggtcctgccggtcagccgcgccaaggcagaggaaacacagaccgcctttatggcgtatatgaggagtctgcgcccatgaatttctggtttgaaatggcgattaacgccgtagaggtaacccttattttgagcttcttggtgcagtatttcggctaccgcatggcctgtccggcgaaatacatatggacggcactctttgatgtgctgtccttcggcagtgtagcctttttctcctgggggaagctgtatgaaggctatgcaagcttgatacagatactgatcaacattgcgttttgctgtattttgctgcgcgggtcaattctgcagaagatatttgtttctgcatttacaatgggccttgtggctgttattgcaacttttacggcactgcttgttgcaaagctatccggaaataatgttaccctgctgctcagccggtttaattcggttcgtattatctcgattttgataaccaagctgctgttttttgtcatcacgcggattatcctgcgggtgaaggaaaacggtaaaatcaaatggctggatgttatcccgctggcagcgattccgacattatccattattacgattacgctgatgatgtacgcggcgatacaggaaccgcatattcaaaatattgtattttatgcggtgtgcatcgtgttggcgctgaatatcctgatttatttcctgtttgttcgattggggcaggtcagcaaaatccagaccgaaatggcgctgctcgcgctgcagaacgaatgcctgcaggaaaacgccaaggacattgagaacatgtatgacacggttcgtgcgctgcggcatgacctcaaaaatcatctgctctgcattttatccatggcggaagaacgggatgtcgagggtatcgagcagtatacagggcagcttctgcagcagcagaatactgtcaacaagctgatcatgttttcgggcagcaaggtgctggatgcgatcatcaacagcaaaagcgcagccgcggaacgggcaggcgttcggctgagtgctattatcacaaccccgctggcgggtatttcgccggaggatattactatcatcctcggcaatgcgctggacaacgcgattcgtgccgcaaaagacagtcagcgcaaggtggtggatattcatattcagccgcagggagcatacagctcgattgtgattgccaatgatatcgcacatccggtgctgtcggacaatccggcactgcgtaccacgaaaaatatccggtatcgccacggcttcggcattcagaatatgcggcaggcagtggaacgaaatcagggactgattcggttttacgagcagaacgaccggttcatctgcgatattttgctccttaacgtgcaaagcaggaacgaataacgactaagcaagaatagccggttgcaatttcggtgaaaagcagttatcttacagatagaccatgataaatgcaatgtacatgggttatctgctgagataactgcttttttgaggtgagtccgatggtatgttgaaatgaaaaccggtaaggtatggatagtaattagagagcaaacagggagggttaaatgatgaacagatttcgaaaaatactgagcgccgcgctggcaggctgcatggcggtctctgcgctgatgatgagcgccggtgcggcgaataccggcacagaagccgcacgcgagaaggccatttacggcagtcaggcgtggacggtgaacggtgcggcagccattcagcacagcgacggcacagtagagccggtaccggagttctcggcgctgtatcctgggtggacagtgccgaagcaagcggcttcggtatcgagtacggcactggctaaggtggctgatgtcggttcgcattcgatcagcggctattaccggaatgtgtatttgacgcaagatgtgaagtacaagccgttttacagttttctgggaaacggtgagacggtcagtgcgtttgcggtgacgataccgggcagcaaatacaatctgggcatttacaacgagacagcgcagcaagacgcaggctggctgccgaatctctctaagggcgattgcgtgctgctgcagaccgcaaatggtgtatactgctcgattcgcgcaagcgtaccgttgaatatgccgattgggtattcgcgcatgaaggtagaggaggcagggaaaatcgaaaatgtgggaaagaactgaaacttgcgggtttcagctcttttggtgatgcggaaattgtgcttttgctgccgatcggtagcatatgttctgaaacgatatccggtcatcctaaaactcgttaaaaagatgctgaacctgcactaaaatcagcactaaaatgaagtgccgcgattttggtagacactcgtggtagacaccggtttttcacaaattacatcacaaaactaaataccgtaaaaagtacagaaaaagagcttcaaacataagtttgaagctctttaacttggtgcggatggggggacttgaacccccacgtccttgcgaacactagcacctgaagctagcgcgtctgccattccgccacatccgcatattctgttgttgaaagaaggtggtgcgagtgacgggacttgaacccgtacgtcgatcgacacacgcccctcaaacgtgcctgtctaccagttccagcacactcgcattctgttctcatcgagtcgcctcactgtcagcgacaagaattattatatccatgtggacgccaaatgtcaacaccttttttcaaatttttttgaaaaatttcaaaacgcgaaaaacagacgatttctctgccacgcgtaacagtttgtgtgttacaatagaagcagttagaaaacttacagcgaaaaaggaggaagacttcagtgctttctaaaaaaagtaaggcaatcggttttatcattatgtccgcattcggttttgcgatgatggcggcattcgtgcgtctggcgggtgatctgccgttcacgcagaaaacatttttccgcaatctggtcgcggtggcagtggccgccgtggtgctgtgccgcgaaaaggttggttttaagtgggaaaagggcaacctgccgctgctcatcatacgcgcaacctgcggtacactcggcattttctgcaattactacgctattgaccatctcgtactggcagatgcaaacattcttaataaaatgtcgccgttcttcgctatcatcttctcgctcattctgctgaaggagcgggccagcgtatttcagtacgcggcggtgcttgcggcattcggcagcagcatgctgattatcaagccgggtttttcctcggcaaccttcccggcaattatcggcctgctgggtggcatgggtgcaggcgcggcctacacctgtgtgcgcgcactcagccggaaaggcgaaaagagcgcccgcatcgtgttcttcttctcgatgttctccacgctggtatgcgtaccgtctatgatcatggactaccacccaatgacatggggacagttcttctgcctgatcggcgcaggtgcgtcagccgcgctcggacagttcggcgtaacgctcgcgtacgccaacgcaccggccaaggagatttcggtgttcgactacacgcaggtcatcttctcggctgtcctcggctttttcctgttcggccagctgccggacggctggagcgtcctcggctatctgctgatctgcggcatttcggtcgcggtgttcttctacaaccgcaatctggagcgcaagggacagtaatatgatcgagtacgaactggttcgctccaaacgcaagacgcttgctgtgcaggtgacgcgcgaaggccgtgtaatcgttcgtgcgccgctgcggctggcaaaatatcgcattgaacggtttgtcgcggagcatacggactggatagcccgcgcacttgccgatcagcagtcccgccgtgcggcacatccggagccggatgaggccaagcaggctgagcttatccgccgagcgaaaatagagctgccgcccaaggtacagcattacgcaaaactgatgaacctgtacccgaccggactgaagatcacctcagcgagaacacggttcggctcgtgcagcggcaaaaacagtatttgcttctcatggcggctgatggactatcccgaactcgctatcgactatgtggtggtgcatgaactggcgcacattgtacataaaaaccatggaccgcagttctgggcgctggtggagcgctatttacccgattatcgtgcgcggcgtgccatgctgcgcgaatgagaacaggaaacgagtatgaatatgacgaatcaatacaaaattctggcattggatttagatggaacgctgctggatgcgcagagccgcatcacgccggagaacgcccgcgcggtacgcatggcgcagcaggcgggcgtgcagatcgtgctgtgcaccggacgcaacgtgcgcgaggtgcgccgcttcagcgaacagctggaagccgcaccggactggctcgtcaccgcaaacggcgcggcagtgcagcatccggacgacagggaaccggcgtttttcgacggcctgagcacagaaatggtggacatcatcctgaacgagtgcactgccattgataccgacccatgcctgtataccacgcaggatttgtactatggacatgcttttcggcatttcctcgaaaacctgcagcggcgcggacgggttgtcatggacgaggccgacgagggttatcactttgtcggggacaagaatacgtggcgcactgtgctcgcagacgagccgcgcccattcaccaaggcgattctttatcacgatgacccgaatgcaatcgcgccgctgacggctgcgctcgataaatacggtattttcgagcttgcgccgtccgtcatgtacggcggagagctgcgcaatgtcgaggtcaaccgcgtgggtgtgcacaagggacgcggactggaatggctggcgcatcacctcggctgcacgctggccaacgtcatcgccatcggtgacagcgaaaacgatctgaccatgctgcagatggcgggactgggcgtcgccatggcaaacagcgagccgtgcatccgcgaagcagcggacgttatcaccggcagcaatacggaaaacggcgtcgcgcaggcgatttaccgacatattctgggggatgaacgatgaaaaaagtagtggcaatcggtgaactgctcattgatttcgtgccgcagcagcgcggctgtgcacttgatgaggtcgtgcagtttgagcgtgtcgcgggcggtgcgccggccaatgtggcaaccgcagtggcgcgtctcggcggcagagcgcagatgatttcgcaggtgggagaggacgcattcggtacgcacattctcaaaacgctgcacgcaaacggcgtggacatctcaacggtgttccgcaccggacgggcgaataccgcgttagcgtttgtttcacttgataagaacggcaaccgcgagttttccttctaccgcaatccctcggcagacctgtttctcgatgaagcacagatcacgccggatattttcgcggactgtgccgtgctgcacttctgctcggtcgatctggtagatgcacctgtcaagcaggcacatcgcaaggccatccggctggcaaaggacgcaggcgcgttcctctcgtttgaccctaacgtgcgtctgccgctgtggggcagcccggaaagctgtcaggcagcgattcgtgagtttctgccgtatgcagacctcgtgaagctgtcggatgatgaagttgaattctgcaccggctgcaaaaccgagagggaagcggcagagcttctgttttcgcagggctgcaggctgctgctcgtgacacgcggcgcgggcggcgcggcagtctatacgccgaacgcgagcgccgaaaccaaagcgctgccggtgacggtcgcggataccaccggagcgggcgattcgttcatcgggtcgttcctgtatcagcttacccgcgacggtgtgacagcggaaacgctcgcagacatcccgcagaagaaacttgcggattatctgacattttcgtccgaatgttcggcgtataccgtgcagcataagggcgcggttatgccaacggaagaagaattgagaatgaaaaatggataatggagaattgaggttgcgcgcaaagcgcgttatttaattaccgccctgtgggcggacaccttcattttccattctccattctcaattctcaattttccattaacctgccactaaaatttattgcacaatgtgtgcgaacgtggtataattttgaggttataaagaaatgataacgattcttggcatcgacccgggctacggcacgattggctatggcgtggtgcggttcgataatatgaaatttacgccggtgcagtacggtgcggcaaaaaccgctcccggaacaccgatgcacctgcgcttatgtgagatttacgatgatatctgtacgctggtggacacatttcacccggacgaggtggcaatcgaggagcttttcttctcgaaaaacgtcacaaccggcattcaggttgcgcaggcgcgcggtgtaattctgctggcgctggcacagaagggactgcatccggtatcctatacaccgaatcaggtgaagctgtccgttgtcggctacggcggcgcggagaaaaaacaggtgatggaaatgacgaaaagcattctccatctcaccaagctgccgcgtccggacgatgccgcggatgcgcttgcgctggccatctgccacgggcattcccggcaggccatgcgctatgaaggcttattatgaggtttaaatagatgttttattatgtagacggcacggtttccgtgctccagcagggtcttgcggtgatcgactgcggcggtgtaggctatgcctgccacgcttcgcagaacaccatcggcaagctgaaaaccggcgaaaaagcgcgtctgctgacctggctcaatgtccgtgagggcgtgtttgagctgtacggctttatcgacgaggaggagaagtcctgcttcctgatgctgaccagcgttaacggtgttggcccgaaggcggcactgtccatcctgtcggtcgcaccgccggacagactggcgctcagcattatcactggtgatgaaaaaatgctcatgcaggcgccgggcatcggcaagaagatcgcacagcgcattgtacttgagctgcgcgacaagatgagcaaggagcagctggagaccgcatctgcggcgtctcctgtggcggcagccgccgtttccggcggtgtcaaccacacgcaggaggcagtcgcggcgctcatggtgctcggctatacgcaggcagaggcactgcacgcaatggagggtctggatgctgccggcatggaggcggacgagatcatccgtcagtgcttgaaaaagctggtcaagtcctgattctggacgataaaagcctgatcaagtaggggagtgtacctttgagtattgaattttccggcggcatgatggatgatgagcgcatcatctccacccgccagctcagcgaggacgagaccgagaattcgctccgtccgaaatccatggcggactatatcggtcagaaaaaagccaaggaaaacctgagcatttacatacaggccgcgaaaatgcgcggtgaatcgctcgaccatacgctgctgtacggtccgccgggtctgggcaagaccacgctcgcgggcatcattgccgcagaaatgggcgtgaatatccgtgttacgagcggtccggcaatcgaaaaagcgggagatttggcggctttattgacaaatctctcagagaatgatattttgtttattgacgagatccatcgcctcgaccgtgcggtagaggagatcctctatcctgcgatggaggactatgcactcgatatcatcatcggcaaggggccttcggcgcgctcgattcgtatcgacctgccgaaatttacgctcatcggcgcgactacgcgtgccggtcagatgaccagtccgctgcgtgaccgcttcggcgtcatgctccgtctggagctgtattcgccggaggagctgtgcggtattgttgaacgctcggcaggcattcttgatgtaccgtgcgagcacgagggcgcattcgagattgcgcgccgcagccgcggtacgccgcgaatcgccaaccggcttctgcgccgcgtgcgagacttcgcacaggtaatcggcaccggtacgattgacagaaaaagtgccgacattgcgcttcgtgcactcgagattgatgagttaggtctggataacgtagaccgcaggatgctcaaaagcatcatccagaactacggcggcggtccggtcggactggacacgctggctgcgaccatcggcgaagaagcgatcaccttggaagatgtttatgagccgtatctcatgcagatcggctttctcagccgcacgccgcgcggacgctgcgtgacgctgcaggcttaccgtcatttgaatctggaaccggcggacggacagcaaatgctgtaatgcaatcgtttccccgcctttatcatacaagaaagttaggtgtttcatttgggtagatattttggaacagacggcgttcgcggtgtagcgaactcggaacttgatgcactgctggcgttcaagatcggcgcggcagcggcatacgcacttacgcaggagtctgcacacggccgcaaggcgaagctgctgatcggcaaggacactcgtgtatcctcggatatgctggagaacgcgctggtcgcgggcatctgctcggttggcgcggatgtagagctgctcggcgttatcccgacgccggcggtcgcttttctcaccatcaagcacaaggcagatgcgggtattgtcatttccgcaagccacaactcctttgagtacaacggcatcaagatttttgcaggcaacggctacaagctgccggacgaaaccgaggcaagaattgaggatctgatcgacgatttcgagtctattccgaagatgacccacgagaagatcggccgtgtactcaaaagcgagatcgacccggtagtcgagtacaccgaccaccttgcagataccatcaagggcgacctgtccggtctgcgcgtggcggtggactgtgcaaacggttcctcctccacaacggtggagcgcctcatgcgtctggtcgagtgcaaggcggaaatccgcttctatgagccggatggcatcaacatcaacgataactgcggctccacccatctcggtcagctgaaggagcgcgtccgctcgggcaattttgatcttggcgttgcctttgacggtgatgcggatcgctgcctgatcgtagacgagaccggcgaggagctggacggcgaccgcattatggcagtctgcgcggcacatatgaagaaggaaggcaagctgcgcggcggcgcatttgttgccaccattttgtccaacatgggtctgcacgcctacgccgataagaacggcatgaagatcgagtgctccaatgtaggtgaccgctatgtgctcgaaatgatgctcaagaagggctacattctgggcggcgagcagtccggacacgttatttttcttgagtatgcgtccacaggtgacggtgagctgactgcactgcagtttatgtctatcctcaaggcgagcggcaagaagtgctcggagatcgcggctgaggttgagccgtggccgcagttgatgatcaatgtcaaggtgccgaacgataagaaggctaccctgcagcagctgcccgaggtcaaggcggctatcgatgcggcttccgcagagctgggcaataacggccgaatcctggttcgtccgtccggtacggaggcgcttgtgcgcgtcatggtagagggcacgaacagtgagcaggtagatactttggcaaaaaaggttgccaaagtcatcgagtctgttgtataatgtaaaagagccaacgggagtgggtgtggtttgcacacccactttctgcattctgaacagggaggtgggagcatttgcgcacaattccataacatgctaagcgccagaactgcggtgcagccggtatcgcagttgacgaggaaagggttaatcgaaagtattcggcgggtgcccttcggtcacaagtgggttgatcgtcagcaggctgttaaaacatacgggcgaccgtatcgacagagcagttatgcgtaacgcactatttttatacccaaaattagaaattcaccgcatatattgaggtaaggcaatacggaataattaaacaagagcgatttgtgagagagttttgcggaccgacaaggcgcgaccggagttcgcgcaagaagccgcagctttcattattccgtgctgcctaaggctcatactgaaatgttgcggaagatatgttatatttaccgttgcaaaggagtattattttatgtgtggaatcgttggattcaccggacgcgagaacgcgcttccgattctcatcaagggtctgtacagtctggaataccgtggctatgactctgctggtgtggctgccttcacgaaggacggtctgcgcgttgtcaaggcgcgcggccgcattgcaaaccttgaggagaagatcaaggaggaaggcggcgacatgtactgcacctgcggtatcggccacacccgctgggcaacgcacggcgagccgtccgaccgcaattcgcatccgcatctgggcggcaagggcaaggtagcagttgtacacaacggcattatcgagaactacaaggagctgcgtgagcgtctggaggcgcatggctacgagtttaagtccgagaccgatacggagactgtcgcgcacctcgtggactatctgcacaccggcaagcaggaggatctggcaaagaccgttctgcaggccgtgcagcgtctgcgcggctcttacgcactgggcgtagtctcgatggataacacgcaggagatcgttgctgcacgccgcggcaacccgctggttatcggtatcggtgagggcgagaacatgatcgcatccgatattaccgctattatcaatcgcaccaagcgttacattattctggatgataacgaggttgcaatcgttcgcccggacagcgtagttgtcatgaacgagttcggcgatacggtagagaaggaaatcatgaccgtaacgtgggatatgtccgcagcggaaaagggcggctaccagcactttatgctcaaggagatcatggagcagcccaaggcagttgccgatacggttaagccgcgcatcaaaaacgatgcggttgtattcgaggacaacggtctgaccgacgagcgtctgcgtgagatcgagcatatccatatcatcggctgcggctctgcactgcacgcaggcatggtcggcaagcgcgtgattgaggcaatgtgccgcattcgctgcacggcagaggttgccagtgagttccgttatgagaacccgatcatcggcaaaaaagatatgtgcatcgttatcagccagtccggcgagacggcggatacgctggctgccatgcgtctggccaagcaggcaggtgcgttcacgattgcgatcgtaaacgtcgtttcctcgacgattgcgcgcgaagcagatggtgtgctgtatacctgggccggcccggagatttcggttgcgacaaccaaggcatattccgcacagctgtccgctctgtacctcatctcggttaagatcgcgcgtgtgcgcggcctgatttccatcggtgacgagcgtgcgctgtgcgctgagctgcagcgtctgccggagtgcatcgagcagaccctgaaatgccagtcggatatgcagcgtatcgcaacgctgtacgcaaaccgctcgagcgtgttcttccttggccgcgggctggactatgccgccgcgctcgaggcttcgctcaagctgaaggaaatttcctatattcattcggaggcgtacgctgccggtgagcttaagcacggcaccatttctctgattgaggagggtactctggttgttgctctggcaacgcagccggcactgtttgagaaaacagtctccaatatccgtgaggttgtagcgcgcggcgcaagcgtcgtgctcgtcaccacggacgatttcaccggggacgagtcggtctgccagcacatcgtgcgcctgccgaagtgcctgtatgaattttccgcttcgctttcgattattccgatgcagcttttggcatactatatcgcagtggagcgcaactgtgatgttgataagccgcgcaacctggcaaagtcggtaactgtagagtaaaacgttaataatattgtcataattgcataaaagaagaagcgtgtttttgtgtgatatcggtaaagatgacaatcgtttcttgacatttccaattctaccgcgtataatagctattgacatgagaaatgattatcaaatacagccatcgaacgggattcccgatgaaaagctgtgccgtctggcgcggcagggagacggacccgcgatggagaatctgatccgtcgttatacccgtctggtcaagacctgtgcgcggccctactttctggcaggcgccgatgcagaggatttgatgcaggaggggatgctcgggctgctgaatgccgtccgggagtacgacgagagcaagggcgcaccctttggagcgtttgcacggttgtgcatcacgcggaagatttattccgcagtgaaggcggcagcgtcgctcaagcacgacccgctcaatcagtccatgtcaatcgatcgacctctgtttgaagaccttgcggaatcgcgtacccgggtaactgcaccgaatggtgatcctgaatcgcttgttatcggcaatgaggagagggaagagcggaaaaagaagctctactcgcttttgtctgaatttgaggcacaggttttgacgttgtttttggacggcttatcgtatgaagagatgtccgaagcgctgcacaaaccaatcaaatctgtggataatgccgtccagcgcatcaagcgaaaatcggcagccattaaacctatttaggcgatagcaggcgcagtgtctgtacgcatatatttcaagtttcccgagggaacagtatcaaagagaggtaaaaaccatgtacgaagacaagactttagtatgcaaggaatgcggtaaggagttcgtgttcaccgctggcgagcaggagttttacgcagagcgcggtttccagaacgagccgcagcgctgcaagtcctgccgcgatgcgcgcaagaatgctgcacgcggtccgcgtgagttcttcaccgctacctgtgctgcttgcggcggcgaggctcgcgttccgttcgagccgaaatctgaccgcccggtatattgcagcgagtgcttcgcaaagatgcgtgagcagtgataccgtaacggtaaaaaatcaataaatgacacgttaaaagtgccagtaatgacttctcattgctggtgcttttttctttgcccaaaagaaaggaatcagcaagggaatgtatgtgttccgaaaaatgataaagaaatgaagaatcgaatccgcaggcgatgggcggcttgcggcaaaagaaaacctctgctcaaaaatgagcagaggggatctttttgattttaagcaataatgtcgtatcccagaatcaagccacgtttctgccgatcgtcaaggtcagcaatagcggcatcaatactgggaaataagcaggggcagatatggcctttgctaagattcacgaagctgtacatgtttgttcccttgtgggggagcagaagtacgtccagcgtttcgttgcgcttgaaaatgcagaaatgcatagagaagagcctcctttacttggtttcgttgatggtaagcagctcttcgatcgtctctttctgccggccaagaaagctgagatagaaactgtcagaaacggaaaatgcgatgaatgctgcgtgcagcagaaggactccgatatgtatgagaagaattatgatctctgcgatgttcatattttttgatgtgtaaaaggcataggcgggattggtgagaagcagataaaagtcccgtaagataagcacactaaccggaatcagggcgaacgataaggcaatccaaacgcgggtgtctttcttaagaacctcgtacaaatgcagaatatcggcgtgcttggtttccagttcctcgcgcgaaaagcgggaatagtaatccaagtcacatagcttctgatgcttgaattcggctgcgccgtttttatcggactttgatggtatattactgagcataggcgataactcctgtagatcggggtagttcttgataaaaagaaaaggaagactctaaggtctgatgtcgataaggaacaaaacctaatcaaacaaaagacggctgaaaaggcttgggttacaacaaaataagcaaaaaacggcactgttttagaacggtgccgttttttgttgcccggattgccctacgctgtcgcagaaatggagggcaatcatcatgtcagaacctatcactttggattattattacggcttggaagccgaacagtacactttcttccgcatccccaaaatccttttcagtcccacctacaagacgctttctgtgtcggcaaagatgctgtacgcgcttatgttggaccgcatgagcctgtccgcacacaaccgctggatggacgaggacgggcgtgtgttcatttactttcgcatgagcgagatcatgagcgctcttggctgcggtcacaacaaggcaatcgccctgtatgccgaattggagaaggtcggtcttatcgagcgcaagaagcaaggcatgggcagacctgctaaaatttatgtcaagaactttattcctaaaaccggaagtcagcgcccccaaaaggaagtacccgcaacgcctgttagtgagtatgatgacttcccctcagcggagcgtaataataagaactacaagaataatacttacatcagtgatactgatccatccatctatccagaacaaccggaagtcacagagccggagaatcagccggagcagatagatacgatggatgagatggatgagtacagagaacttcttgaggaaaatatcgacctcgaatatcttcggcacaatggtcacgcagaggatgatctactggacgaaatcatggatctgcttactgacaccgtaacaagcaagaaatctactatcaggatcggcggtgaggacttaccaaccgaagttgtgcgaagccgactgctcaaactggatgcaagccatgtcgagtatgtgttggacagcttgctccaaaacaccaccaaagtccgaaatatccgagcgtacttgctcacagcgctttataatgcacctactacactcagcagctactacaccgcattggtcaatcatgacctgtatggtgatcggtagctgcttttttcataagcggcggtagatctaccgtcaaaatctaacgcgcaccgtggcagaaacgcgcccggtgcgcgttttctgtttctgcggtgccagcggcatcacgctgagaaaggacactgaatgacgcagaacgatgaccagcgacgcagactgttttgcatcctgcgtcggattgccgtgccaccctggtgcacccagctcacgatcaaatttcaaaaaacggaggtaattttatgaaacttcattccaatccccatcggccgaggtcgattttggcaggacttcttgctctgaccctgatgttctccatgctgcctaccgcctttgcggcacagcagaacagctaccatgaccctgcggaacactggatgcaggcatccggtcgcacgaatgagctggatgccaatagtgttataactcatgaaacctttacctgccatgagtgcggcaagcagacctcatttcttgcgtttcgtgtgccggagtacacgaaaaacggtcagtctgcactcagccgcaatgtgaaatactcggacggtactatggtcggcggcaacggcaagggcgacacgatggacggtgttcccggcaagaatgcgacctataccgggtatcactacacgaaagccgtctgcgaaacctgcggcggtatcaacaccaatatggcaacgacggactacggctatctgaaaaatgtgtactggctgtatgactgtgctgccgagttcacgcagaaactcgacgaaaccgtgacctacgagtacgcagacgacacctaccacaccgtcaccaccaaaggcggcacctactgtgcgttctgctacggcacgaaccacaccgaaagcagcaaactggagcgtcacagcatggtaacagaggtgctgccccagccggcgaacggccgctttgcagtagtcgagaagtgtagcctgtgcgactatacccactatgactatacggcagcaaaagccgtcatcgcggactattacggcatcgcagacggcaagtcgcacacgatcacggtcagcgacctctcggaagcaggtgtccgcaccgctatccgctatggcaatagcgcagacagctgtaccatgacctcggctcccaattatacagaagccggtcagtacatggtatactacgagatcacctacagctacaagggcaaggaaatgactgagaacggcgttgcaaaggtctggctgcgtgacgaatccaccaaggatgacggctcttgtgcctgcggctgtggaaatcctaactgcggctgccaaaacaagaattgcaacggaaattgctgtgccgacaagggctgcggtgaaaaccacaagtatattctgctggacagcaccaaggccggctgcaccaccctcggctatgatcgctacctctgtacggagtgcggcaagatcgaaaagcgtgactatgtggactctctgggccacgcatggcagagcatcgtcatccgtgacgccacctgcgaagcagacggcaagcagctggagctgtgttcccgctgcggtgagatgaagcagaccgccacacccaagggcgaacataagtacaaaacctataccgtttctgcgacttgcacgacacccggtcataccgtccgtgagtgctccgtctgcggcgaccgtcatatcgaggacatcacttctgttctgccacataactacgaatcccatgtgattaccgccacttgcgaaaacggcggtaagaccatccatcgctgcgacggctgcggcagcagcttcgtgacagactacaccgacgcgctcggccatagctgggatgagggtacactcgtcaccaatgccacctgcaccggcgagggcgtcatggaataccgttgcacccgctgcggctatcaccgaattgaaggcaatgaggcggcaggtcatgtgccgggtacgcctacgacttgcaccgaaccccagctttgcaccaagtgcggcgctgtgctggcaaaagcgcttggtcacgactacaagagcgaagtaacggctcccacctgcacggagatgggttacaccaccaacacctgcacccgctgcggagacagcaacaagactgactacaccgagcctgccggccataagccgggtgattggatcatcgacaaggagccgaccaccgactccgcgggcagcaagcataaggaatgcgaaaactgcggcgaaaagctggaaacggctgaaatcgagaaaatctacaacagcggcacaacggacagcaagggcgaagtcgttgtaggcggttatctcgtgaccgtcaccgatacggatacgaagaatcccgtcgcaaacgccgccgtcgcgctccacaaggacagcagcatttccatccgcctgccgaacagccgcctgttggactacgcagatcagaccactgtcaccgtgcagctcgtcaaggacaagtctgctgtgccggacatgagcatcgctgtcgcggacaagaacgacaactatgctgccgataagacgaacaaggcaggtcagatcaccgttcccaccggcagcggtaagaccaacgaggacggcaaggtcaccggcggctatgaggatgcggacggcgaccgctggacgctgaccgtcaaggtcatccgcacggataccaagcgtcccatctccggcagtgatgtttccatcggaaagaccggcaacatcaccgtgaaactgcccgacggtacggatatggatgccaagcatcaggtgacggtcattctcaccgaccacaagaagaacccgcaagaaaacaagaatatcactgtcaagggcgacctgaatcagacggaaaaaggcaagaccgacaagaacggcgagcttaccgttccggagatcgaggagaccgagcgacacggcgtttacatcgtcggctatacggacggcgcctttggcccctcccgcagcatgacccgcagtgaagccgccgcgatctttgcccgcctgctggcggagaagaacggtgacactatttccactgcggcaaacactaagtttacggatgttccccgtaatgcgtggtactctggctatgtgaagtacctcgccaacaatggcatcacctacggtaagagcaagaccatctttgcccccaatgatgccattacccgtgccgagtttaccacgatggccgtccgtttcttcgaagtctatggcgacggtgacgccgaaatcatggagcagtttagcagcttcaacgatgtttcctccggctattgggcggcggaatacatccgctatgccgccaagcatggctggatcaacggctatggcgacggctccttccgcgctgacgatgagatcaaccgcgcggaggtcgtgaccatcgtcaatcgtctgctgggccgcgaagcggatgaggactacattgcagacaatctccgcaagatgaacaccttcccagatgtcacgaagcgccattggacgtattacgccgtcatggaagcggcaaacgcccataccgccgtgctgggcgagagcgaaagctggaacaagtgattttcggtttcccctgcaccgaaaggacggtgatgcaccatgcaggaggaactggagaaaaagacagtggttgtgatcacgaccggcgcaaagctgacggaaagattgctgaaaagcctgatccgcaaagcactggcagaaatgcagcgccagacgcagaaccccaaagtctatcggggaaagcagtcagtaaagcacctgttgcagcaaggcggcggtgcatccaccatcgaggtgtccagcgccagtatccgaacctttgagcgtgttgcgcgaaaatacggcgtggattttgcggttagaaaggatagcgcggcggaaaagccgcgctatctcatcttctttaaggcgcgggatgctgacgcgatgaccgctgcctttcaggaatatacggcaaaggtcgtgcagcgtgagaagaaaccgtctgttcgggaacagcttgccaagctgcggatcgctgtgctggacaaggaagcggctccggcgaaaaccaaggacaaggaggtgtcgctgtgaggaaaatcgcaaagccggatgctgccacactcaaagcgctgctgccgtatggcatgatcggtctgcttgcgaccaagctggggcaggcataccggttggcgaccggcgcggacattatcgaccgtctgatgaatacggtcatggtgctgaggcgcgtaatggagcatccactgccgagcctgcacccgttcgacctattggtcggtatgtgttgcggtgttctgctgtggctgacggtgtattaccggaaaaagaacgcaaagaagtttcgccacggtgccgagtacggcaccgcccgctggggcaatcagaaggatattgcgccgttcatcaatgacgatttcgcacagaatatcctgctgacggacaccgagcgcctgacattggggcagatcgcggacccggaaaagcggaatgtgaatctgaatgtactggtgctgggcggctctggctccggtaagacccgctatcatatcaagccgaaccttttacagatgaacgcatcatatgtatgctcggacccgaaaggtacggtcgtggaggaggtaggacaagtcctcatccagaaaggacattacaagctgaagatcctgaataccattgatttcagcgcttccatgcactataaccccttccattatctgcacagtgaaaccgatatactttcgctggtcacagtcatcatggcgaacacccagagcaaggaaaagggcggcgatgatttctggcagcaggcaacggcactgctgctccaagctctgatcgcctatatttactatgaagcgccggaggaagaaaaaaactttgcgatgctgctggatatgctcaatgcctgcgagtgccgcgagggggatgagaatttcaaatctcccgtagacctgctttttgataagctggcgaaacgcgagccggatcacttcgcagtgaagcagtataccaagttccgccaagccgccggtgatatatgctctaagtgacttcttaatcatgattttgtcatggttagtgaagcaatcacttagagcatttttgtttcaggaggtacagccatgagaaatgaaaaaattaccccactgtacgagcgcctgagccgggacgacgagttacagggcgagagcaattccatatccaaccaaaaacagatgttagaggattttgcccgccggaatgggctgccaaaccctacgcactttacagatgatggtatctcaggcacccgttttgaccgccccggatttttggcgatgatggaggaagtggaggcagggcgtgtagaggcaatcgtcatcaaggacatgagccggttggggcgcgactatctgaaggtcggtcaggtcatggaggttttgcggcaacgcggtgttcgtctgatcgccatcaacgacggtgtggacagtctgaaaggcgatgacgattttaccccattccgcaacatcatgaatgaattttacgcccgtgataccagcaggaaaatccgttctgtgtttaaggcaaaaggtatgagcggcaagcacctgaccggcactgtgatttacggctacttatgggacgaaaaacgggagcattggctggtagatgaggaagccgccgaagtggtacgccgtatcttctccctcacgctggagggatatgggccttatcagattgcctgcaaattatccgcagatcggattgaaattcccgtcgtacaccttgcccgcttcaacgagggtgtgaaccgttcaaagccggtcaaagacccctatggatggggatcatctaccatcgtgaacattttgaaaaaacgagagtatttggggcacaccatcaatttcaagacccgcaagcactttaaggacaagaaaagccactatgtttctgaggacgagtggacgatctttgagaatacccatgaagccattatcgaccagcagacctttgatctggtgcagaaaatccgcagcaatgtacggcgttatccaaacggctggggcgaagcagctcccctcacaggcttactctattgtgccgattgtggcggcaagatgtatgtccaccgcaccaacaatggcaagcggatttctcaatatacctgttccaattataccaaagttccgtgtgggacactatgccttacacaacaccgtatcaatgagagtgctgttctgacattggtttccgacacactccgggctatcgctgaatattcgagaaatgaccggacggaatttattcacactgttcaggagacgcaggttgctcaacagagtgccgatatatcgaaaaagcgcaggcatctggctactgcccaaaagagagccggagaactggaaaaactgatttgcaaaatctatgaggataacgccctcggcaagctgccggatacacgatataaggcgcttgatgcacagtatgccaaagagcaggacgcacttgagattgaaattgcggagttggaaaaggctgttaccggctatgagcagagccagaaatcagcagagaaatttatagccctgattgataagtacgagaattttgacacgctgacaaataccatgctcaacgagtttgtagagaaaatccttgtccatgaacgctcccgaaaaggcagtcaggataccacgcaggaaattgaaatctactttaattttttaggacgctatattccaccatccttacagccggttcctttaaccccagaggaacaggaagaattgcggaaaagagaagaacgcaaggacaggctccatcagaactatttgaagcggaaagccagcggcgcacagaaacggtatgaggacaaaatcaaggcgaagaaaaaagcggaaatggacgctaagaaagccctgatccgggctgaggatatgaaaaaaggtgttttttctactatcgggcagctaccaaaagaagaaccgcgcaaaggcagcatagcagccagcgcagcagtctaatcatcacggagcaaaggagcatgaatatgagtaagttgacttacattcgttgtggagattatgatatacccaacctaaaactttctgaacagccggaaacttctatcggcaagtacggcaggatgcgaaagtcctacctgaaggaacaccgtcctattctctacaaccaactgctgatgagcgagaaactgtatccgcacctgttagagattgattggacagcgcaggagcgcgtggacaccatgttgcctcacatgatggaggctgcgggtgtcactgaggaactgaaagcctgtgatcctatgcgctgggtaggactgatgaacacattaacggcacagattgaggaaattttaatcagggaactgatttgcagttgaatgggaggtgtgggaaatgctgacctttgaaaaggttctggaagtgtttcaggcatatctggatgatgatcctctgtatgaggtggtgcagaccagccacggttatacattgatggcatgggaacctcaccggaatgactggtacagcgccgaaatacagaaaactccggaggatttgcgaaacgccttgctggatacatacgccaactttctggaagataagattaccggaaatgaccgcgatctgactgtgacagaaaccggagaaatccagcagaggtgccgggaactttgggaaaagtgccgggaaacttgatatagaaacgccagaaggaggccgcgattatgcgtcctccttctgcttcgcagtctgttccattttgagcgccccgtctatggcaccttcgataatcggcaggtattcttcagggcaaagcttcagcttgtggctgactcgttgccgctgttcgctttcttcccgcatgatctccgggttaaaataccgttccacgggaagtccgcagaccttaatcaactggatcatcacaggcaggctcggaatcgcaccttgattctcaatgttggcaagataccgccattcaatcccaaccatttctgccaatgtttttcgtgccagacgctttgcctctcgtgcggctttgacatctgcgccgaaggtttcaaaaccgggacaatcttcaactttcgccatataacatcacccagttacattgtataattcatactttgcctgtggaatgttgctatatgcaggttggttgaagtttataattcacattccgtttcttgcattgttcgagaaagagaactataatgtactctgtggaggtgcgaaatggactatatgacattgaaagaggccgccgagaaatggggcgtgacacctcgtagggtaaattattattgtgccggtgggcgtatccccggcgctgtgaaaatggccggtgtttggctgctccctaaaactgcggagaagccgcttgatggccggacaaaacaaggaaaggaactacgccatgaataaaattttgattatagatgatgacagagaactgtgcgctttgattaaacgcagcgtacaatcggaacatatagaagccgatttttgtaataccggaaaagagggcttgcagaaattaaaagagcaggagtatcagcttgtggtgctggatgtgatgatgcccgatatggatggctttgaaacgctggaagaaatccgcaaagagaacagcctgccgattttgatgtttacatccaaaaatgacagcatttctaaagtgcggggcttacgggccggggcggacgattatctgacaaaaccgtttgatatggacgaactgattgcccgtattgcgtccctcattcgccgctacacccgctttaatcatcaagccggagctgtgcaaaaactggattttgatggattgcaaattgaccttgaaaatcgttctgttacgacggaaaatggcacttttgaacttccaccaaaggaatttgatctgctcctgtactgcgcaaagcatcaaggaaaaattttgacaaaacagcagatttatgaggaagtttggggcgaagaatatttctatgatgacagtaacattatggcgattatcagccggcttcgtaaaaaattagaagtcaatccttcaagcccaaagtatatccaaacggtcaaagggattggctaccgctttaataaggaggtatagccaatatggaaatcatcgttttcttgtccattgtgattgctgttgtggctgtgctgacttccatcgttctcgttcggcgcgtaaaaaaacaaatcgcagaaatgaccgatgtgctggttgatgtgaaaaacggaaatggcaaccggcgtattctgtctgcaacaaatgaattgacagcacctcttgcctatgaaatcaatgagattgttgtgtcctatgaaagcagactttcaactgtacggcagacagaagaaaccaaccgccagcttatgacgagcctttcccatgatgttcggacaccccttaccactctgattgggtatcttgacgctgcacacaaaggactggtcacaggaaaagaccgggatgattatattgaaaccgcccgacggaaagcccatgatctgaaagaatatattgatgtgctctttgactggttcaagttaaattccaatgagtttgctttggaaatccagagcgttgaggccgcagagctgacaagaaatatcctgattgactggataccgatttttgaggataagcaggtcgattatgacattgatattcccgaacagcctgtccgggtaagattggatacggacagctatatgaggatcatcaataatctcattcaaaatgtaatcgctcacagccatgcggacaaaattaaaattgccctgtcaaagcaggaaaataacatgaggctgctgctggcggataatggtgtaggaattgagaaagaagatttgaaacacatttttgaacggctttataagtgtgataaaggtcggtctgaaaaaggcagcggtcttggtctttctattgtccatcagcttgtagaaaagatgggtggaagcataacagttgaaagtttgccgggaaaaggaactgaatttatgttgctttttcctttggagatttaagtgggttcccgtctttatggcgggaacctttgtcattttgccggatttcaaattgcaaggttaatgcaaggttgcggcaaggttaatgcaaggttggcgtgatagaatactttacagaacaggaggttttgaatatggacacaaattacatcattgaaacaaaaaatctgacgaagcaatacggctcacaaaagagtgtggctgacttaaatatccatgtgaagcgtgggagaatttatggtctgctgggcagaaacggagccggaaaaactactaccatgaaaatgctgttgggcttaacaaatccgacttccggggaggtcaaaatctggggaaagcccttgcaggggaatgaaaagaaattgctgccccgtatcggcagcttgattgagtcccccggtttttatccaaatctgaccggcacagagaacctgcgtatctttgctactctgcggggcgtaccaaacaatcatgccatcaaagatgctctggatctggtaggactgccttacaaagataaaaagctcttttcacagtattctcttggtatgaagcagcggcttgccatcgcccttgccgttatgcacgatccagaacttttaattttggatgagccgatcaacggtctcgatcctatcggtattgcagaagtacgctcctttatttgggagctttgcgacgcaagaggaaaaaccattttgatttccagtcacattctttcggagatttccttgctggctgacgatattggaattatcgaccacggcgcattgctggaagaagaaagccttgctgaactggagcaaaaaagcagtaagcatatccggtttacactctctgatactgcacaggcggcaagaattttggaacgcaatttccatgaaaaccatttttccatacaggacgaccacaatctgcgcctgcacaaccttgatctgcctgtggggaaaattgtaactgcctttgtagaaaacggattggaggtatcggaggcgcatacttgtgaagaaagtcttgaagattacttcaagcgtgtgacagggggcgaaggaattgcttaaactaatcaaatgcgaatttttgaaattaaaacggaagcccttggtatttatttctctgctgctttctgttttcatgccattggcttatgctttctttctggcagatgtaaacactgatgtggatgctgtaaatggagtgatgtccagcctgttccagctcagtgcttatttgcttttgatgccgctccttgtgatactggcttccaatctgctgtttgaggagctggacaatgacacactaaaaaaccttgttaccataccgataaacagaaccaagttggtgctgtccaagatgctggttttgctattgtttgccgttggctttatggcagttggaggattggtaaatcttgcggttttgctgtttcagggctgggagccggttgggttttggaccttgtttggcgttgggatagaagaagggctgattatgtgggtaggcgcacttccatgtatcctgctcgttgttcttcttaataaaaactatatcgtgtcggtcgtgattacctttttctatacgactgcaaattatatcctttcgatgagcgatgcgttcctcacacagccttttggtttgaatatcggaaccctgtttccgggaccgctggctttccgctggaccttccaattttatgaccaaagccagaccagtgcggaattggcagacttgttggaacggatcagtccgtattttctgaatggtgttcaggtgttcggtgtgattgttggggaagccgttgtatttcttgcgctgattgcgttggtttaccggcgccaggaaatctaagggggtgtaattatgtggaatttattaaaagcagaattgctcaagctacgccggtgccaaatactttgggtggggctggtggcgcttgcactctgtccgttggtgcaatatgggagccagctgattgtggaggcggagtaccgaaatccaaactatgatttttccactctgtttgagaatgttgtctggggcaatacgcagatgttttttccgatttcactggtgatgattggcagctggctgattgacagagaatccacccatgatacgctgaaaaacatcatgacaattcctgtttccatgccgaaaatgctgggagctaagctcttttgggtcgggatttttgcagtcctgctgggaatatacagcgttggcgttaccttgattactggattgacggttggattatcgggactgacagtggaagtgttttttcatggaggtacacagatcgtgttggcagctctgacgacctatttggtctgtatgccgctgatcttgatttttgggcagatccgaggggcatatctgggaggttccattctggcgtttttccttggatatagcatgctgttcttcaaaggcggtatccttgccagcatctatccgttttctgctgcgctgattttagtgggctttgacatgagtggatatgccggaacaaccacagccccgaatcctttgctggcagtcattggggttggcatcatggttctctgggcggtgctgttgttactgatgtccagtaacaaaaaagaaataaaatcccgtaaacaggcaaattccaagggaaaaggaaagcgtgctgtacgcaggaaaggaaggtgatacctgtgaagaaaatagttctatcattatgcttgatactgttgggcgcttctgtgctttccggttgtacaaaagatgaagttctcgatcagtataacaatattgttcagtctgctggttccatagcacttaccggaaattcatccttacaaggtacgaaagaaaaaggaattgatgattatacaggaagctatacagccaactatgaggatttttcagatacagagtatttgttcggcggaacttccataaagcgtgaagcgggtaaggatctgtctattgactgcgcgctggaggttacggatggaactgcaaaagtattttggatttctggagctgatgaagaagtcactttgcttgaaacaaccggaacatatagtgatacaattacactccctgaaggtggaaactatatcggcattgaatgtgaaaatttcactggaagcattgaattgaatatggagtaacattctgccggacgacggcaaaagaaaaaaagccgtcgtaaagcagacacatttccacgcgcctatgaagcggtggctttgatttcagagccgccgtttcttttcgtttatcctaaaccaacgacgacctaacaccgtgtaaatccacggcggcacataggaggatgccgccgtgtctatgtttgccttttttcacagtacccatgacctgcaccagctaaaaaaagcctgttcccagcagcggagcaatgcggtcagaagtatgcactataccatgtaattaaacagcaaaatatattccatgacgctcgtatggctttatgccgtccgggcgcttttttgtccctatggagccggaacatcgggtcagcatggcccgaactttatccccggtgccgcgccccaccaccccattcagattttcccaaaaaagtctgaatggaggaaggacagatggaagttaccatcaattataacggacaagctgtggccgtggaggtcacgctggaagtctatgaatttcttgatcgggcagatcacaaaacggagaacctgttccatgaacagcggcggcattgggatggccgggagtttgacgagtacatcattaccaccgagggtgtaggagcctacggcgaaacgccggaagaatacctttgccgcatggaaacgctacatgagctgatggcagttctggacacctgtaccgaggcccagcgccgccggttcctgctctatgcgcttgacgggctgagccttgcagagatcggtgtgctgtgcggctgctccaaagtggctgtgtatcaaagtgtggaggcggtcagaaaaaaatttataaatttctttgagagcaggcttaacgaatgacctgttttctggctaccaagtgaaagggatcatttcccttatctcagcgaggggcggacagcggacgagctgcccgcctctccgattttcaggaggtaagcctatgaaaacaatcaatctgcggtggatgtatccccactaccggcatgacgagtttgtggatgttacggacgaggtatgggcagcgatgtatcaggcccagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctgcacctgatagcagctctgccggtggctctggctcatgccactccgacacaggcccgccgtgttcacgcctactacattgccggtatcaagcagccggaaatctcccggagagagggcgtccacagcagcaaggtcagcgtttccatccgtcggggtctgcggaatatgcgccgctgctatgatgacctttttcaaacagagtgagggcgtgcctatgcagaccatcaatctcaaacaatattatccattttgcaaagaggacatttttgtggaggtgtccgatgagatcgtcgaagcgtttcttctggataagagagccgaggccgccagagaacgcaagatgttccggtataaggcgttttactccctcgattgtaacgatggaatcgaaaatgctgcaatcggctgggcgcagccatcgccggaggatcatctgatagaaaaagaagaattagccgaatacgaagaactgatacggcgattgtatgaagccatttcttccctgccgcctatgcaggctcgccgtgtccacgcccgctatatgctgggtatgaaagtgaaagatattgccgcaatggagggtatcacaccatcacaggcgggaaaatccatccacgctgcactgcggaggctgcgccggtactttgcgcgtcagaaatggacggtcaatctataagcgtttccaaagaaaagaggtgcatgacatgaacgaaaaaattacagcccaacccccaaaagaagaacggcaggaagtcctgaaggagatccggcagcttgaaaaccgcaagaagattttggagaacaagcaacgaaacgaagaacgcagggttcgcacccgccgcctgattgagcgcggagccattttggaggggattttcccgctggcttccagcctttccggcgcagaggtcaaagcatttctgattgccctgtcctatcttccgggggctgcggaattgactgcaaacctgccaaaatccggggatatgccataagtcccttgtttacaagggcgcacttatacaccgttgccggtgctgtgcgccctgccgggggcgttgcgtacttcgtccgcgatgggaagctacgctccccaaaccccttgtgtgctctgcgcagccaaacacccgctttgcgtttgtccggctccacagagcctgttatcccctcactgaaaggaggtgttccccatagatttctgtcatatccccgtcagtatcatcaagcgcagcgcaggccgttcagccgttgccgcagctgcttaccgcagtggaaccaagctgacaaatgaatgggacggaatgatccacgactacacccggaaaggcggcattgtccatgcggagatcatgctgcctgcccacgccccgccggaatttgcagaccgttctatcctctggaacagcgtggagcaaatcgagaaagcaagagacagccagcttgcccgcgagattgaggcagctttaccccgtgaactgtccggcgaacaacagcttgcccttgtgcgtgcctatgtgaaggacaactttgtagacaaaggaatgtgcgccgactttgctatccatgacaagggaaccggcaaccctcatgtccatatcatgctgacgctccggccgttgaaagaaaatggacagtggggcgcaaagtgccgcaaggcatacgatctggacgagaatggacagcgtatcccggatgggaaaggcggctggaaaaatcatcgggaggatacgaccgactggaacgataaaggaaatgtggagatttggcgggcagcgtgggcagcctacaccaaccgggcactggaatctgccggtagaccggagcgtattgaccaccgcagctacaagcggcagggcattgataaaattccctctgtccatctggggccagctgccagccaaatggaaaagcgcggtatccgcaccgacaagggggaagtaaaccgacagatcgtcgccgacaacaagctgctgaaagaaatcaaagctcgcattacccgtctttatcgctggtcgaaagcggaagcggaaaaaccacaaacgcagcaaagcagcttgaccgccttgtgggaagcccaacagcagttgaacgctccccgcacccgcaccggcaaaatccgggctttgcaggaaagcgctgcactattcagctttttgcaggtaaacggcatccagtctatgcagcagcttcatgaaaaaatcgctgatatgaacagctgttactatgacctgcggggaaagatcgtcaaggctgagcgccggatcgccattcttaccgaacgcggggagatgtgggaacagtacaaccagtacaagtccatccacaagcagcttgccaaagtaaaaccggaaaaacgggaacagtttgagcagcgccacagccgggaactgatcctgtatgatgcagcagcccggtatctgaaagaactgaaagacagcggcgaggggatcaccccgaaggcatggcagcgggaaatcgaccagctggccgccggaaagcagacggacacgcttgccatgaaatccatgcgggaggagttgaaagcagtggaacggctccgcaaaaccgccgagcagctgtcccgacaggaaagggacaagtctcacgaccgtgggccggagcggtaaaggctaccgcgttttggcgtacccctgtcaagtgcgtcgcgtttcacgacatacttttgcatacagaaaaaccgccgtacaggtttccccatacggcggcagactgtttatttgccgaacaagtcgctgtgtgtgccggtgcgggccagcgtcagcaccagaacatcatcctctatgcgatagacaagcagccagtccgggagaatatgacattcccgatgacctgcccaatcgccggacaggtcatggtcacggttcttatccggcagcggttcgcccattgccagcaatgctacgacctgctccagcagctcaatcttcaagccacgcttgatggctcgtttgtagtcctttttgaaactggtcgtgtacttgacggtatatttggtttctttcatcttttcaggtcagcaaataactcgtcaaggtcattgtagccctttacagacgggtcttttgcaatcctttccgcttccagcatggcagcaaccgtttctttgttcggctgttccagccttacttcaaagggaatgccgccttcacgaagcgactggcgcacaaagatgttaaacgccgtagtcaggttcatgccaagttccgtaaacagtgcgtccgcctgcgctttcaaatctgcgtccatgcggatactgatgtttgtggtatttccagccatacgatcaacccctttctgctggcaattatagtatatgccatttgcacgaagaaaacaatactttgcacgaatatttaacaataaattcattcaaggaggttacctgctttatgaaagaaatcatttatgaagaacaacaagactgaacctatccctgtcatggattaccgccagtaccgcagagcgcggaaactggtgcatgagtgctgcaactacattgccggaaactgtatcgccctggacgatggggaggaatgtatctgtgtccagtccatttcctactccctgttgtgcaggtggtttcgggcggcggtattgccgcaggataaggaactggaaacggcgctgttccaccggctgaatgctaagaaatgcgccgtatgcggggcgctgtttacccccggttctaaccgggctaaatactgcccggaatgtgccgcacgcatgaagcggattaacgccgcaaagcgcaagcggaaacaacgggagaaatgtcacgctttaggggctgaaaaacccttgtaaatcaaggctttttttgagggtgtcaaaggcagtctgatagatttatcctctgacccctaaaatagccttaaaatgcgtacagaatcccaaaagaacccctaaggaggaaccctatgtcagacaatcgaaaatattattacctgaaactcaaagaaaactattttgatgatgattccatcgtgctgctggaaagtatgcaggacggtgtgctgtattccaacattctgctcaagctgtacctgaaatcgctgaaacatggcgggcggctccagcttgacgaggacatcccttacacagcgcagatgatcgctaccattacccgccagcagatcggcactgtggagagagccttgcagatctttttgaagctgggtcttgtggaagtgctggacagcggcacattctacatgagcaacatcgaacttttaataggccagtcctctaccgaggccgagcgaaagcgggctgcaaggcttcaaaataaggctctttctgcgctccggacaagtggcggacatttgtccgacattcgtccaccagagatagagatagagttagagaaagagatagagataaagagagagatagagaaggtacgccctgaaacggggcacccttcccacacctatggccgttaccagaatgttttcctgacggatgaagaactggcagacttgcaggtcagctttcctgctgtatgggaacagtacatcgaaaagctgtccgagtacatggcttctactggcaagcgttatcagagccatgcagcgaccatccggcgttgggccggtgaggacgctaaaaaaacggtcacaccctcacgcaaccgggattacagcgtaaaggaggatgaaactgtatgattgagattaccgcagaaatccgggcattcatcgacaaggcagctgccggtgtggaattggctgaggacgagtatatagacccgtcagacgggctcattcactgtaagaaatgcggcggccagaggcagaccgttgtgccatgcttcgggaaatccggctactttatgccgcactgcatctgccagtgccagcgggaggctgaggagcagcgcaaggctgctgaagaacggcagcgccgcatggagcgtatcaaacgccgaaaggcacagggcctgcaagaccgttatctgtacgactacacattttccaatgataacaggcaaaacccattgatggacaaggctcatgcctatgtggagaactggaaagaggcatataagagcaatatcgggcttttactgtttggagatgtgggaaccggcaagtcttttttcgccggatgtattgccaacgctctacttgaccaggatgtgccggtgctgatgacgaacttccccaccattctgaaccgcctgacagggatgttctctgaggacaggtcagagtttattgccagctttgacgaatatgacctgcttatcattgacgatctgggtgtagagcgcagtaccgaatatgctatggagcagatgtttttcgtcatcgacagccgctatcgcagccgaagacccatgattatcacaacaaacttgaaactgtccgagctgaaaaatccgcctgatctggcccacgcccgtatctatgaccgtattttggaacggtgtgcgccgatcctctttgacgggaagaatttccgggaagaaaatgccggtgtcacccgacaggcagcaaaagacattgtaaacagtaagcacgattgattttttaccgggcggcacagacccgttcggagaaaggagcgctatgaacaaagaaccccgtactatgcagatggcagacgccgctgctgcggccagagcgccggaaaacacgccagcgatggtaaagaaaatcggcaagacgacctacaaggttcatgtccatttcagcaataccagcacagaaaccatgagcgataaaatcaagcgtatgctcaaaaatgaaattcagcagatgtgacagactgataaactaagccgccttgtgctaaactgatgatggtacgcaccaaaatttttgtcaaggaggacatgaaaatgctttacacagaaaaagagaaacatgaaattgagcgagtaaaggaagtctttgcggaacatctgcggcaaagccctgattttgaattgctctggtcggacaaggtgggctatgtctggctgacgattggcgtaaatccagtctatgtggataccggtatcaggatagaatctgccgccgatctctgcggcaagtgtttggatgatgttgctacggatgttttatatatgactggcaacgatcatgcactggaagcagccgacccgctggagttagccgaaatcaagcggctctgggagccatatatcaaccagctgccagactatgcgtatctctgcaaagacctgctgaacggaaaaatgtaatctgttaaatgaggtgtcaggagccatacagtgcttctggcaccttttgtgagttttctgtgaatttgattaaaaagtccttgacaatttgtctctggcaaaactctaaaatctatcttgatttcgtgtagtgcggcgctggctcccttcgacattcaggaggtgcgtgacatgatggcgtatgacgaaatggaactggaaaagctgggcgatgaaaaaatcgcactgttctgcatcgtgtccgatgtggacccgaccttcaattttctctccgcgatgctgtattcccagatgttcaatgtgctgtgtgaccgtgcattgaaggtctatcacgggcgtttgccggtccatgtgacttgtcttttcgatgaatttgcgaaccagaagatcccgaactgggagcatctggtcagtgtcatccggtctcggaatatctcggcacatattgtgttgcagacctacagccaactcaagggaatgtataaggacaacgctgaaaccattgccggatgctgttccacgatgctttttctgggcggcaaggaggaaagcagcctcaagatggtgtctaccatgcttggcaaagaaacgatcgatgcgatgaacaccagcgacacccgcggcagtcagcgcagctatggactgaactatcagaaactcggcaaggagttgatgagcgttgatgaattggcggtcatgccgtcgagccggtgcatcatgcagttacagggtgtgcgtccgttctactccaagaagtacgacttgacgaagcatcccatgtaccgctatacggcggatgccaacaagaaatacaccttgaatgtcaagcaatatctatcgcaccggctgcgcttgcagccggacgaaacctacgaggtctatgaccttggggaggccgctgacgaagcggtatgacctacccgctgatctaccattccgacatgatcggcgggcagtttttcatatatccacattttcaaaacataggaggacaattttatggaatttttcagctctgcggtttccgcactctctacgatggtcacggcgatcggcggcgtggtcggcatctggggcgtcatcaacctcatggaaggctatggcggcgataaccccgcgtccaatgctcatgtacggtagagaagcacaaagcaaaacaaagacagccagccctgccactattccgaagtcaggggaacgcaatagaaaaattcatagctgtgtgctatacttaattagcatttgaacatatcaagctgacacagcaatctctttgcttgccgttaatgcgcgtctaccaatagtccgcagaaagcaagagtatcgtaaaggtataaaaatttcaaacttctttgtaacgaaattccgatttctccgtctaacctatgaagctgaaggaggtgatgacaagtatggactatgaaaagctctataaagcctactatttacaggtatactcgtatactatttctcttgccaaaaatcgtgagatagcagaggaaatcacgcagaacacattctataaggctgtttctacaacatcacaattcaaaggtaagtcagatgaattgacatggctctgctccatagcaaaaaatctttaccatgatgaaatgcgaagccgtcagcgagtagctgatgtgagtgaaatcaatgacttgccatcaaatgaaaatgttgagaactcagttgcagattctgacatggcgttccgcatacacctcgttcttcaccgtttggaagaaccatacaaagaagtctttcagcttcgcgtattcggggaactatctttttcacaaatcgctgcaatttttggaaaaacagaatcatgggcgagagttacttatcatcgtgcaaagctaaaaattcaagaaaggatggatgaaaagcatgagtaaacaatgcgatattgttcgagatattcttccgctgtatgttgacggtgcttgcagcgaagcaagcgcagagatggtaaaagagcatttgaacgcctgtgctgactgtaacgcaatttatcagaaattgctttctcacacgaacgaagatgttcttcacgaagaaagcgaaagcgttattatgcgccatgaggcaaaagaaaagcagagaggcaaaaaaaagataacgattgctgttctcgtttccatcgctctttgtatcattgcaatttttgcagctctctttctgttacctataaacattgcttatgagcctgtcaaaatcgacttcccatttgaggttgaagatgtcgaaagcgttgaaatgtaccactatgacgaagtgcctgcatcagcagaaaagaaagtagttgttgctgaaaatgatataaagaccctgtatgataagttcaagggcttatccttaaaagacaaaacaactgaggaaactgccggagcagctgtgaccagctttagatttaacctctcagatggaacaagctacgatttgatttacgcctgctatggagttaaaaacggcgaattgaagtcagcagcaggcggttttaagtatttcacaagtgcggatatcggctcttattggaacaatttgaatacggaacttgaagcaattcctatcaatgagagtgaattgccgtgagcagatagcaaacccagccgagcctgtcaacggtcaagatgaacggcggaaatgcgccgctgttgacagccccgcccgtctttgctgttcggtaatcaagagggcgacagcacaagatgctgccgccctctgccattattcagaaagggggattttccatgaccgaacacgaaaagtatcaagaacatatccggcatacacacgatgccttttgcaagactgttattcgccacgctgccatagacgcagcccggagcatacggagccgccgcaagcgggaaatctcgcttgaatatctgatagaagaaaaacactatccattcagtaccacagataaatactttgcggagcaatccggcatgaccagctatccgcttttcgtctgtggtcagatggtgcttttggaaagcccagagcttgccgcagccctgtccgcactatcacagatggaacaggaaatcattttcttgtactacttccaacgattgacgcatagggagattggacggagatatggacgggctggcaacacaaccgggcggcgtattcagatgattttacggcggctacgggcagagttggagggtttgtcctatgagccagctacttccctatgagacaatcgttaaggcaagcgagggcgacccggaagctgttgccgccgtcctatcccattatgcgggatatatccgctcttgtgcgaaaatggacggacagattaacacggatatgcaggagcatatcgtcaggcaactgatagaaagcctgttgaagttccactttgaccgctaaacagaaaagttgtataattagagcctaacaaattaaacttcaatgagggtagagcaaatggaacagattatcaattatagagacatacccacagataaaaggattgacatattaaatgctcttgagcgaataggtttttttccggcatacggcggcgtgaaaacaatgcagcaaattatggaaaagtcagttccaggttcaggcccacaattctatttcgttttccgtgaaaatgagttgatagggtacaattttctcattggggacactaagaaatataaagcgttcccatggcttgctattagcaatatggatgagcagaagttgactgtttgtgaagaaatgatgaaaatacaaattgccttttttgaaaaactcggaatgcaaaagatagcagatcattgcgttaggattatggaagattacagaaaaggaattggaaagcagaaagaaagcgattgcagataaattccatttgaaaaacggctgacaatttaataccgccgcccatcacagcggcagataagcagtaaatcttgaaaaggtttactgctttttttgcgcccattttcaaaaatctttggcaaaccacaccgccggattgttgtagggagcagacaggtaaaacaaaaaaatttccgctgcgtttgccaaaacgcccccttttcaccgttgtagtggtgaacagcgggcagaacacgccgccgcaatcgctatattggtggagcaagccagtatatccgcaaaccagagccgccgaggaaagcggtagttttttagagcaagattctaccgcagtaccaaaattcgcttttcgctcattttgcccctgcgggaatcttgttggggagtgccttccccaaaccctgcttatgcggcttgcgccgctgaaaaatccctcaaaataatttttcggatttttcaaaaacagttccgctttacaccctgtttttctcctattagtgagaggacaccacgcacagccgaaaggaggttttaccatgcgaaaacgatataacacgccgcaccgcagccgggtagtcaagacacgcatgaccgaggaagaatacgccgagtttgcggaaaggctttctgcttacaacatgagccaagccgagtttatccggcaagccataaccggggcagccatacgccccatcataaccgtttcccccgtcaatgacgagttgcttgccgctgtcgggaagctgatcgccgaatacggcaggatcggcggcaacttaaaccagatagcccggacgctgaacgagtggcacagcccctacccgcagcttgccggggaggtacgggcggcggtttccgaccttgctgccctaaagtttgaagtcttgcagaaagtgggtgacgctgttggcaacattcaaacatatcagctctaaaaatgcggactatggcgcagcggaagcctatctcacatttgagcatgacgagtttaccatgaagcccacccttgatgaaaacgggcggctgataccgagggaggattaccgcatttcttccctcaactgtgggggcgaggatttcgctgttgcctgtatgcgggctaatctccgctatgagaaaaaccaaaaacgggaagatgtgaaaagccaccactatatcatcagctttgacccacgggacgggacagacaacggcttgaccgtagaccgggcgcaggagctgggcgagcagttctgtaaagagcatttccccggacaccaagccttagtctgcacccacccggacgggcataaccacagcggcaatatccatgtgcatatcgtcatcaactccctgcggatttatgaagtcccgcttctgccctacatggacagaccagccgacacacgggagggctgcaagcaccgctgcaccaacgccgctatggaatatttcaagagtgaagtcatggagatgtgccaccgggagggactttaccaaatcgacctcttgaacggcagcaaggaacggataaccgaacgggaatactgggcggcaaagaaagggcagcttgcccttgataaagagaacgccgccagagaagccgcaggacagccgaccaagcccaccaagtttgaaacggacaaggcgaagctgcgccggacgatacggcaggcactttcccaagctaccagctttgacgagttttcttcccttttgctgcgggagggtgtgaccgtcaaggagagccgggggcggctttcctacctcacaccggacaggacaaagcctatcacagcccggaagctgggggacgattttgacaaggctgctgtccttgccctgctcacgcagaacgcccacagagccgccgaacagaccaaagccatacccgaatatcctgccgcagttaaaaagccgttacaaggggaaaaaaccacaaaaaccaccccggcagacaacaccttgcagcgcatggttgaccgggaagccaagcgagccgagggcaagggcgtgggctatgaccgctgggcgtcaaagcacaatctaaagcaaatggcagctaccgttaccgcctaccagcagtacggcttttcttccccggaggaactggacgaagcctgttctgccgcctatgccgccatgcaggaaagccttacagagctgaagcaggtggaaaagacactgaacgggaaaaaggagctgcaacggcaggtgcttgcctattccaagacccgccctgtccgggacgggctgaaacagcagaaaaacgccaaggcaaaagcagcctaccgacagaagcatgaaagcgactttatcatagcagacgcagccgcccgctatttcagggagaacggcattttcaagctgccgagctataaagccctgcaagcagagattgaaagccttatcaaagagaaaaacagcggctacaacgattaccgggcaaaacgggaggaataccgccgcttacagactgtcaagggcaatatcgaccagattttacgccgggaacgcaagcctgtgaaaaggcaggaacaggagcgataaaaaccgccccaaaatgtacccgaacccatacagaacaagggggctgccccacaccctatccccaataccaaaggattttttaacgggcttacagggcagaaaaaccccgaaaatgataccgagatgatacagaattaccgccgataccgccacaccagcggaaacggcagaaaggagcgcacccatgccaagaatgagcaagaaacggcggctggaatggtcttttttcctgcggcaagtaaaagtcgggaataccacctgcgaccgtatcacatacaacgacctctgccggggctgtacccatagctgcaagcagagcttccgggcggttatcatactctgcccccactactactccaaacgccggaaaaaggaggacagggacaatggcagataaccgcaagtattactacctcaagctgaaagagaacttttttgacagcgactccattgtgctgctggaagatatgaaagacgggattttatactccaatatcctcttgaagctgtacttaaaatcgctgaaaaacggcgggaaattgcagcttgacgagcatatcccctacacagcgcagatgatagcgacactgacccgccaccagatagggacggttgagagggctttagagattttccggcagttggggcttgtggagcagcttgacagcggggctttttatatgaccgatattgagctgatgataggacagtcctctaccgaagccgagaggaaacgggctgcaaggctggaaaacaaggcacttttaccgccccggacaaaaggcggacatttgtccgacattcgtccaccagagatagagatagagttagagaaagagatagagatagaaaaagagagagagggagaaacgggacaccccgcccccgctgcttatggcagatacaacaatgtgatactgaccgatacagagctttccgggctgaaaacagagctgcccgacaagtgggagtattaccttgaccggctttcctgccatatcgcttccaccgggaagcagtaccacagccatgcagccaccatttacaagtgggcgcaggaggacgctgccaaaggcaaggctgccccgaaacagggcatacccgattattcatgcaaggagggcgagagcttatgaaaaacgagattgaagctatgattacggacattacaaccactaccaccgaagcggaggattacacaggcgaggacgggcttttatactgcggtaagtgccatacgcccaaagaagcctattttgcagagggaaagacttgtttcgggcgtgaccgccacccaacagactgcgactgccagcgggcagcccgtgaaaagcagcaagccgccgaaagccgacagaagcaccttgaaaaagtggaggacttgaaacgccggggctttactgaccctgctatgcggaactggacatttgagcatgacaacggcagaaacccacagaccgaaaccgcccgcttttatgtggagagctgggaaaccatgcaggctgaaaatatcggctacctgttttggggaggcgtggggacgggaaaaagctaccttgccgcctgtatcgccaacgcccttatggagcaggaagtcccggtgtgcatgacaaactttgcaacgatactgggtgaccttgccgccagctttgagggcaggaacgaatatatttcccgcctttgcagctaccccctgctgatacttgatgattttggtatggagcgagggacagaatacgggctggaacaggtttacagcgtgattgacagccgttaccgaagcggcaagccgctgatcgccacgaccaacctcacgctggaggaattgcagcacccgcaggacacgccccacgcccgtatctatgacaggctgacttccatgtgcgcccccgtccgcttcacgggcagcaacttccgaaaggaaaccgcacaggaaaagctggaacgcttaaagcaactgatgaagcagcgaaaggagagcctatgacagaaacgaaacagacaagcaccaccaaaacagaccgccgcccggactgtgtgacggaaatccgcatgggcaactccgtccttaccgtttccggcttcttcaagcagggcgcaaccgacaccgcagccgacaagatgatgaaagtgctggaagcggaagctgctacacaaaaaacggcgatttgaccgaccataaagaagcagatttgacgcttttgccgctatacagacagccgccccatgtggtacaatcaaggtacggaatagtggggctggctgtcggaaacggaggattttatgttaagacagaccaaccaacaaccaattaccgccctttacccaagactttcccatgaggacgaactgcaaggcgagagcaattccatttccaaccagaagcgtatccttgaaacctatgcaaagcagaacggcttttccaatctgcgctggtacacggacgacggttattctggtgcgaactttcaaagacccggttttcaagccatgcttgcggacattgaagccggaaaagtcgggacagttatcgtaaaggattattgtgcgataataggactaaatcagaaagaccttgaaaatcaaggcattctggcttagtcccttctttttttgaccgaaaacaaaggactttcacaataatcaagcaagccggagtgtgccgctgcacacttccggcagaaggaggatatagtgggtgctatcaaagtcttcttgaaggaggttctgcttccaatcgcgcttgcgttctgcctcgcgtcatttctcaagccgatctatatgcctgacggcgtatgtgactacttccttatgtggatctgcgtcggcttgccattcggcatccggaggatgtgcctctggctcgttcccagcggctacggtatctccggctcagtcggcatcttcgcattgaacttaatcataggcggtcttatcggaggacttgccttcttcatcgggctgctgctcggtgtcattcataccatccgagaaatcatctgaactacatcgtaaacgaagagggtttgtttcttctccaatttggagtaagaagcaaaccctctttttttgttgcccaaaagccggaatatttgctggcgatgcggcgaaggaaaggagtttttaagcatgaaacgcatgacagccggtgatctgcaagcactggaattgctgatgcagaccacacccggctttgagcactttgacagcggcgcggatggcattctccctgagtgccgaagctgccgctttcaccgtcctcactggaaatatcagtcctgcgtgtttgcagagtgtccctactgctgcaatcccgtttctacactcaaaaatcaaagtggcacatctgatgccggaaaggaaacgtgtcatggataacaaaatcgaagtcttcaagaatgaacagttcggtgaggtgaggacgatcctcgacggagaaacacttctgttctgcggctcagatgttgcaagagcattgggatatgccagacccggcaaggcaattattgaccattgcaagggtgtcctaaaacgggacacccttacgagcggcggtacgcagtccctttcctacattacggagggtgatgtttacaggctaattgtccatagcaaactcccctcggcggaaagatttgaacactggctgttcgatgaggttgttcccatgatccgcaagaccggctgctacatgacggaatccctgctggaccgcattcagaaggaaccggcggtcatcatagagcttgcgcagaccttgcttaaggaaacgaatcgcgccaatgcccttgaagcggagctgggcatcgcaagaccgaaagccgattactttgacgccttcgtcaatccagatgactgcaccaacattcgcaccacggcgaaggaactgaaaatcccggagcgcaagttcgtcaaattcctgcttaacgaagggtatctgttccgctctccctccggtcagcttcttccctacaacaagaagagcaacgaaggactcttcatcgtccgggatttcgtgaccttccgctataccggctctcagacctacttcaccccgaagggcaagaacgtcatccgcatccgctactttggaacctgcggcgttgaagtatctacggaaatggcagggtgatcatgtgtcagtctatcgcgtcaataaaacccgtgacttcacggtcatgggcaatacccacctgagagataagaacctctccctcaaagcagtcggtcttctctcaaagatgctgtccttcaacgacggctggcagttctccacccgtggtcttgcggcactctgcaaggaaggtcccgacgccatactttcggcactcaaggagcttgaggaaaacggctaccttgtccgtcaccgtggcagagatgataagggcagaatggtcagcacggagttcgacatctatgagatgccgcaagccggtttgccacacagggaaaatccacacagggaaaatcccgatgtggagaatccagacgtggagaatccccatagggaaaatcccgcacaaagaaatactatccaagtaattactcaagaaagaaatactctctcaaagaactatcaatccatcaatcttgatgtgatggataggatggatgagcgaaacaggtatgaagagattatccggcaaaaccttgactatgacattctctgtcaggatccgaagttcgataaagaccgcttccgggagatcatggacatcatgctggatgccgtctgctctaccgctccgaccatccgtatcaatggcgaggatatgccgcagcaagtggtcaagtcccgctttctcaagctgaatagcagccacatagagtacgttctggaagcaatgaacaagaacccgtcagacatacgcaatatccgtgcgtacattttgactgctctgtataacgcttctctgacgatagacaattactattccgcgctcgtcaaccatgatttttacgggcaggacaggtcagcagggtcaaagaagcccaaaacctacgattatagcctttgtgaaggcactctttaatgaataccatcgtgagcattgctcggaaaggaggacattgcaaatgaaaattatctatcgccggattgtgccgccttagctttggcagcagtccccataatcattccaacgaaaggaggtaaacgccgcaatgcaggatgaagtcaacaccaaagttgttgcaatcatgatcaagggcggcaagatctcagccgaggtgctgaaaaaggcactggacaagttcgtgcaggagatcgagaaggcgcagaagcagatgcagcatcccaaaacctatcgcggcaagcagtccatcaagcatctgatgagtcagaacgccgccatctccaacatcgaagtgacggacggcaacatcaagtcctttgagcggactgccagcaaatacggcctggactttgcactcaagaaggacgtttctgttgagccgcccagctatcttgtcttcttcaagggacgggacgttgatgtaatgaccgccgccttcaaggagttctccgccaagacggtcaagcagaaggaacagccgtccatccggcacaagctggatcaggagaaagcccagagcaaggcgcagcacaaggagaaagtcaaggtcaagaccaaggatcggggtgtggagctgtgaacaaacccgatgtgaaaaagctcattcttctgaaccttccgtatgtcttcgccttctactttgcggataagattgccgccgtgttccgacttgcacccggcacggcgttcatcgacaggttgacaaacggatttgccgtgttcggcactgccttcgcaaatccgctgcccagctttcatcccgttgatctgctcatcggtgtgcttgccggtgcgctgctcaagttggcggtctacgtcaagggcaaaaaccgcaagaagttccggcagggcgaagaatacggatctgcccgctggggcaagccggaggacatcaagccgtacatggacccagagttctccaacaatgtcattctgacgcagacggagttcctgaccatgaacagccgcccgaagcagccgaagtacgccagaaacaaaaatatccttgtcatcggcggttccggctcaggcaagacgcgctttttcgtgaagccaaacctgatgcagatgcacagttcatacgttgtcaccgacccgaacggttacactataagaggatagaaaaaaggagcgtttcacaaacgaagatttctttgaagaagggaggtcaaaaccgtggctaagaaagaagaaatcaaaattacagccctgtatgagcgtctgtcaagggacgatgaacaggccggggaatcaaactccatccagaaccagaaaaaatacctcgaagaatatgcccgtcagaaagggctgagaaacattcgccatttttatgacgacggttattcgggcacgaatttcaaccgtcccggctttgcctccctgttggaagaaatcgaagcaggtcatgtggaagtcctgattgtaaaagacctcagccgttttggcagaaattacctgcaagtcggctattacacagagattcttttcccgaagaagggcgttcgcttcatcgctgtcaacaacaatgtggacagcgccaccccgcaggacaatgacttcactccgtttttgaacatcatgaacgagtggtacgcaaaggacaccagcaacaaaatcaaggcggtattcaagtccagaatgaaggaaggactgaggtgcagcggctccatcccctatggctataagagagaaccgggcgataagcagacccttatcgtggacgagcctgccgcagaggttgtcaggaaaatcttccggctggtatgtcagggcgttaccacaacaggcattacagagattctgaccaaggaaaaggtgctgataccgtctgcctacgctgccctgaatcagccgaagaactgccgtcacaaggagattgcagacccttaccgctggaacgccaccaccatcggctatatcctcgacaggcaggaatacctcggtcataccgtgttgggcaaatccatctgcgagaacttcaagaccaagcagcgcagagccgcaacgccggacgagctgatgattttccccgatacgcatgaagccatcatcgaccaggacacatgggatattgccagaaagatacgctcaaagaaaaagccgagagtggcgaacggcacctattcccaccgcctgtccgggttggtgtactgcgccgactgcggggcaaggatgggctatatcagcccagaaaccaagcacagcggcaaacgctatgattctgattccgctttccaatgcggcaactaccgaagcgccacaaacgattgcgtctcccactatgtgaaaacatcggttctggaagcggcgattttgcgggcaattcaggcggtgagcaaatatgtccttgaaaacgaagccgagttcattgaccagctcaaagccgtttggaatgagcatcaggcaagagcggcggacaacggacagcaggagcttgccgaagcgaagaagcggatagctgatttagatgaaaaaatcaataagctgtatgaaagctccgtgagcggcttgctgccggagcgacaggcacagcgcatgattcagcagtacgatgaagaacagcttgtgttggaaaagcgtgttgcagagctggaaagtctggttcagcaggacgaaatcaagcaggtggacgcatcccgcttcatcgctctggtcaagaaataccaggactgcgaggatctgaccgacgccatgctctatgcgttcattgacaggattgaggttcacgaagccacaggcggtcgaaccatctaccgccagcagaacattgatattcatttcaatttcatcggcaactactacccgcctgttgaagctgtttccgaggaagaacgcattgcagccatcgaagccgagcagctgcggaagaagcaggaaaagggcaagcaatcaacagagcgcagaaagcagaagctggacgctctgcgggcggctgcggaagccggagaccccgaagcggttgcaaaatacgaggaacatcttgcaattcagcgtgagcgaaatcagaaacaccgtcagaagttgcaggaagccagagaagccgacccggaatatatcagccggttagaggaaaaggagcgcatcaagcgtgaaaagatgcttgaaaccgagcgtaagcggatagaaagagccaaccgcaaaaagaagctgacacgcaaggaactgaaagacgcggcgaaaaccgacccagaagccgctaaagcgtgggaagctctgaaagccaaggaagccgaagccagacagcgcaaaaaggagcatgaggaagcgagaatggcggctgaccccgaatatgccgctatgatggcagaacgaaaagcggagtatgtccgcacaaggactgcccggcgcaaggctgaacacgaagcccttgtggagcttgccaagaccgatgaagaagccgcaaggaaactggcggagaagcggaaatatcaaagtgaagctaccgtcagatgctatcagaaaatgaaagccgatgcggaagccggagaccccgaagccatcaggcgatatgaagccacccttgccaagcgcagagatgagtaccacaaaaagaaagcaagacaggaggaagtaccagcatgaaagaattgaagtcaagaatccacgaaaacggcatcgactacattctcgtaggcgattactatgtgccggactggaagctgccggaggaaaaacgccctgtcgggcattggggcaggctgcatcaagcctacctgcggatgtaccgtcccggtttttacagcgaactcgttctctcctgcaagctgcacacctaccttgccgatctgaacgagcaggcaacggaaagatgcagtcttatcattgagcagatggcagaagccgagggcgtggacgaaaccctgaaagcgtccgaccagatactatgggtgcagtctatgaactccatccgcagccgagccgaggaaatcatcaagcgtgagctgatttatgattgacggtcaagagccggaaaaatcgcatatctgacgctgggaacgcttcggacgaggaatgtatcgccggagcgttttccattgaaaaatcgccgttttccccaagtcaagagccggagaaaacgcccgaaaaacacccctattgcgtaacagaggcgcagaaaggagcttgcatgagaacagggcttaccaagcaggaaaaaaccaccgatatatggtttgacgagaaagatccgctgatctatatccgcacccacaacaccgacctcaagaacaggctgaccgcctatgccgcagcgcaccccggcgagtgccgccagaccgacgcagacccggacacgggctgcatggaatttgaaatccgcaaggggcggttctcctttcggctgaccgcaccgtatagcgaggaacgccgcagggcggcaagcgtggcggcgaaaaagtgcggcgttcatagaaaagttgcacatttgtatggagacagtaattgaaaagttcgcaatttgcatggtataatcatattggatagttatatcgttcaaaggctaaaagtgataagtggcggtgcaaggatatgccgctggaaaggagcggaaaatggattttgaagtcagacaagtctactactcatacggcaaaacggttgcattggacggtctttccttttccgcgaacagaggaaaaattgttggtctgattggagaaaacggtgccggaaaatcgactgtcataaagagcatttatcgtttccttcccccggacaagggcatgattctctgggacggaaaagatattttttctctgcgcccagatacttatccaatttcctatatccctgacacgccggttttctatgaggaattatccctgctggaacatctgcattttaccaaggcagtctaccctcaaagcggcgcttccgaaaccgagcttctggaaaggctcgatatgcgtgagcatcaaaacaaaataccgtctgctctctcgaaggggacacggcaaaagctgatgattgcaatggcactgctgcgggagtttgaaatccttattgcggacgagccgttttcaggacttgaccccaaacagattgcaacgctgaaaaccctgctgttggagcaaaaaagcaagggcaaactcgtcattttatccagtcatttgctggacgtggcggagaatgtgtgtgaccagtacgtcattatgaaaaaaggaaaatgccttgcgtcaggctcaaaagaggaattgcttgcgtcaacgaaacttggcacaaacagcaccatggaagcggtttatttaaggttggtggaacagaatgaaatgtcaggctgaaattctgctcttaaaaaacaagctgcggcttatgaagggaacgctccgtcatgcgtggcaacccctgttgggctttttgattgtcggggtcgcacttgcatatcaactcatttttgtggttgctaaagccggacgcggaacggcagtttcttcgcaagggattctctatgttctgctggccgtggtgacaatcaacctgttccgtgtttttctaaaccagacccccgtgttcagaatggaagccgcatcggtgatgttgacctacaatacaaagcagttttacaaagtgctttgcagaaaacagggattgtcagttctgctttcgattttcatcgcgggagtattatcctttattctaagcggttttctgtttgatgctgcgttcggaaagctgtttgggctgcttgcgctctatggctgcaactgctcttttctttcgtggattttctaccatttgcagagcaaagctaaatggctgtcactcccgattttcgcagtatgctccgtcctgttgatactgcactcgttcctctccatcgcattgttggctgcttcgctgtgcgctctctggctttatgcgcagcgtgttttgcgcctgaatctgccgaagtattttgaacggttgcagtttcttgaaatgtctgcaacggcgttaagccataacgactatgtaaaaatgcggcaaatggcggaagaaaatcgcccgtcctatgtcagcgccccaatgctccatcattggaaaccaacgaagcgtaccgctctgtggatgaagagcctgcttgagatcctgcggatgcagaaaaggatactgattctgctggcgcttcttttgttcgtcggatggcttgtatggcgaacggacttgctggcatttgcccctctactggaaaatcccgccataacgaaaggcattgccggattttctgtggcaacggctttcggtacgcttcaccagcttttgattcaacaggtaaaagccgtttcggacaaacgcttgctgggcttgtcgcttccatttacaacggagcaaattatcctgtcctacggtgtgaatgcagccgcaatcaacctgctgcttacccttgctgttggctttctgtactccgctttttcgctgcggttgcttcttttgtggggcattgagggcattgcctatttcgccgtatgctgtgcttctgtgtacgacgtgaaattcaagcgcggaatatctacggcagcgaatgtactgctgtttgcaagcgtatattactgcctgatgatttagggaaatacctttatcggagtacagtttatcagccgaatactctgaaccagaccgttatcgcatatcgcaatgacaacgcaaagataaattgcggttttgacaagtctgaatgatagaaagcaaagccggaatcaagtataatagagttgcgaaaggaaggaggtgttttccgtgagcaaaaaccttgctgataatatcgttgccctgcgtaaaaagcacgggctgtcacaggagcagtttgcagaaaaaatcggcgttacccgtcaggctgtttccaattgggagcgtagaattgcgacgccggatgttgaaaccctcgacctgatagcaaagctgtttgatacggatttgactgcaatggtgaatggagaaagcacaggaacagagaaaccaagggatacgctgcgataccggcgggtgctgttgcttgcgtctgccgcactcacggcagtgcatttcgttctcgcattttccggcaggattcctatgttcccagtggttatcgcccccggcgtccttttgggaatatctttgctgattcactttgtttttctccataccaccgcacagaatgacttttctatcattgcagggtttgacaagaaaaaagacaattctgagattgtaaaaaagcagctcgctacaatcgacctgctgaatcttgcctttgtattatttcttgatgttctgttttttctcatgtacgccgctcccgaagaagatatgcacacagccggattgatactattgggcatatatttcctgtctttggggacaatcgttataggtgtgaatctgaaaatgaaatcaagatagacccatctgatgggtactgtattctttctatctgctgctgatagacttgaggcggcttccagcttctcgaaagatatgccgagcgatgtaagtgcgaagaaaaagctacaactgaataacaatccccaaagcgatcaaccgttaaaagttggtcgcttttgttttgcccatttttgagaaaggagctacgccatgagcaaggaagaatttgaaaaattggagcatgagaagtatgtgcttgaaaagaagctgaccgcagcgaagcacaaggagaagcggttgcagagcgaattgaaacgcctgaccagaggtgagcgcacgcaccgcctttgcacccgtgccgggatgctggaaacctttttgagaaagccgaccgtcttgacagacgatgacgtgatggagcttttgaccttcatcttccacagcgaagcggttcaaaagaagctgaatctgctgattgagaaccgggaaaacgagctgacaacggacgggagctaaaccctcggctttggacgagggcgcaattatacaccacctaaaggttgtgcattgcgttctgccgaaagccccttgcagggagcctgatgatttccgcagctttcgctccaatcatccagcggaagctacacttcccctgcgctggctaaagccagctacccctttgtagaattgccgtccagaaacgatttcagagcaatcatttctgaccgacaagttttgtttgaccgtgccgaaaagcagcggtcattttttattgcgccgagaaaggagattcaacaaaatgcctgttccccatctgaatatccgcatcgtccagcgcagcaagggcagctccgccgttgcaggagcagcctatcaagccggagagaagctgttctccgagtatgaccaaaaatccaaagatcaccgcaggaaacagcccgaagttgtttacacggaaatcctgcttccggcaaacgctccgccggaatatgcagaccgggcgacgctctggaacgccgccgaagaagcggagaagcaatggaacgcacagcttgcaaggcgtttcgtgcttgccctgccgagggaagtcccgcttgaaaaatgtccgcagatgctccgggaatactgcgaggaacatttcgtatccaaaggaatgtgctgcgactttgcgatacacgaccccgacccaccgggacacaatccgcactgtcatatcatgctgaccatgcgagcccttgacgaaaacggaaagtggatgcccaagagccgcaaggtctatgaccttgacgaaaacggcgaacgaatccgcctgccctccggcagatggaaaagccacaaggaggacaccgttgactggaacgagcagtaccacgccgaggaatggcggcacggctgggaggtcattcagaaccgctatcttgaaatgtcgggaagccccgaacgggtggatatgcgctcctatgaaagacaggggcttgatattgtcccgacagtccacatgggagccgccgtctgcgccttggagcgcaagggcattgaaaccaacatcagtaatctcaaccgggatattcaagcggcgaaccgcatgatgaacgctgtccgcagaaccatcaaaaatctgcggagctggattgcggagattctggaagccaccaaagccgcctttgcggaaacggaagcggataagaaaaatacttcccccacgcttaacgcacttctcagcgattacctgaatctgcgaaaggcggagcgcagcgcgtggtcgagatacggacagcagaaaggcacggtcgatgatttgaaagccgtttcccaagccatgaactatttgcaggaacatgagctttttacgctggaggatttggacgctgccctgcaaggcgtgaatgaaaaagccaagacaatcagcgcagagattaagaaagccgagaaacggatgcaggtcattacgggcattcaaagagccgttgccgattgcaggacacacaaggcagtccatgacaagtatctgaaaatcggctggaaaacaaggcaaaccgcctttgcggaaagccacagggacgagctggacagcttcaacaaagcgttccgttatctgaaaaaacaaggcgttgatttgaacgtcaatctcgatgctctgcaaacagaatacgatggcctgaaaagctcccataccgagcttgccgggcagcttgtagccgtcagagaggaattgaagccgatgaaagatattcgctattgggtcggcaaagtccttgcgccggagcaggcggttgagaagaagcccgaaccgaagcactccgtaaccgagagattgaagcacgattcgggacaggagaagcggcagccggagcgcaaacccacacagcacaaaaaacaggatatggagctttaaggcgcttgccgttttcttttgaaaatgtcgggtgtattttttgttccctgaaaggaagatgcgatgaatgtatttgaagcagtaaaaggcaatgttaccgcccgacaggcggcagagatgtacggcattccggtcagccgtcatggcatggcagtctgcccgtttcacaacgacaagaatccgagcatgaagctggatatgcgttttcattgctttgcctgtcaggctgacggggacgcagttgattttgtttcccgcctgtttgggctgcccggcaaggaagccgctatgaagctggcgaacgatttctccattccctatgacgcacggaaaaagccgtctatcagacccaagataagagcgcctaccccggaacagagataccgacaggaggaaagcagatgctacaaggtgttgtccgattacttccatcacctgagaacatggaagcagcagtacgcaccgcagcggccggaggacgaatggcatccgctgttcgtggaagccctgcaacgagaaagccacatcgaatatctgcttgatgttcttctgtacggcacagccgaagaaaagaaggctctggttgccgagcaaagaaaagaggtgatgagacttgaacggcgatttgcagaacacccagacgggcatgaccgtggaagaagtcaggggaagtctggacttgaccgataacggagctatccgaaacagcatacggaactgcctgaccgtgtttcagaacgacccctatctgcaaggtgctatccgctacaacattctgacggagcgcattgatattgtaaagcccctatggtgggagaagcccacagcgaccctgaacgacacggatttcaattatctcatgctctatctggaggacaagtacggactgatcagcgaaaagaagattgaaaaagccatttccattgtcgctgactgcaacaagtaccaccccatccgtgattacctgaacagcctgaaatgggacggcacagagcgcatccgctatgccctcacccggtatctcggcgcagaggacagcgagtacacctatgaatgtctgcgcctgttcatgctgggcgcaatccgcagagtgttcaagccgggctgcaagtttgaggtgatgctctgtctggtgggcggtcagggcgcgggcaagtccacattcttccggctgctggcggtcagggacgaatggttctccgatgacctgaaaaggattgacgatgacaatgtttaccgcaagatgcagggacattggattatcgaaatgtccgagatgatcgccaccgccaacgccaagagcattgaggatattaagtcctttatcagcagggcaaaggaaacctacaaagtgccgtatgaaacccatccggcagatcgactgcggcaatgcgtgttcggcggcagctccaatacgctggacttcctgccccttgaccgaagcggcaaccgaaggttcctgcccatcatggtacacgcagagaacgccaaggttcacattctggaagatgaagccgcatcgagggcgtatatcgatctgatgtgggcggaagccatgttcttctaccacaacttccccgtaaggctgaccttatccaaggaaatgaacaaggagctgaaggtgctgcaaaggcagttcatgccggaggacaccaaggcggggctgattcagtctttccttgacaattacagcggcacacaggtctgctccaagctgatctatgcggaagctctgaaccattcctttgacgagccgaagcaatgggaaatccgagagatcaatgaaatcatgaacaacagcattgagggctggacggcgttttccaatccccgcatctttgccaggtacggcagacagcgaggttgggagcgagccgtttccggcaacgagccatcggcaacaggctcagttttgccggacggttttcgtgagctgaccgaggaagaagcccgccagatggagcttccgttctgaaaggcagaccgtgttgccgacccggttgctgtcccgttgccgaccccgttgccgggctaatcccttaaaaaccctttatctataaggcttttttcttctctgacaacgaaagcaacagagaaatcaaagaaaagaataaaaatagtataagagacggacaggacgatgttgcaggttttttgaagcccgttgccggacttcgttgccgacacacaccctgttcggctttttgcgcacacaaagcaacgctggaaatcagtgggtcaaaatgaaccactgattttaaccgcagcacaggcggaatcaaatgacaacttttgtcacttgatgtagggtggttcaaaacgaaccaccccactttgcagggcaaattccgtaaaatgagctgttggtcacgccgtgcagcagttgccatacacacaaaatcaagtggtcaaaatgacctcttgattttcagaacctaatttgggaggtattgaatgaaagaaacgccaaacacagcaaaggaacacaaggaaattccggcaggaacgttcaacatgaggataggcggcaccacctatgttgtttgcgttcatttcagcaaggagagcaaggacacgctggaagataaggtgaaacgcctgatgcgtgacgatgtaaaagccgccaatttctaaagtgaaaattatcagtaatacttccgttttctatcttgacaaaactgttccgaagggtacggtgctggtagagtgcggcaggatgcttgaaaagggcggctacgtcatcaagtcgctgaacaccatcaatttccggaaatccatgcactacaacccgttcagctacatccgcagcgagaaggacatcctcaagctggtcaatacgatcatcgtcaacacgaagggagatggcgataagtccggcgaagatttctgggtcaaggcggaaaagctctactacacagctctcatcggctacatctggtacgaggcacccgaccacgagaaaaactttactaccctgctcgaaatgatcaatgcctcagaagccagagaggacgatgagaccttcaagaaccccgtggatgtcatgttcgatgagctggaagcccgcgaccctgaccactttgcggtcaagcaataccgcaagtacaagctggcggctggtgttgtatgctctaaaagacttcttaatcaagcggttgggaagtctcttagaacacacaacctaaaaccgaagaaaggagcgcaagttatgagaaaaaatgagaaaatcacagctctgtacgaacgactgagccgtgatgactttggcaaagatgatgaccaacagcgtgagagcaattccatatccaatcaaaaggcaatgttggaggagttcgccgcacggcagggctttacaaacattgtccatttcacggacgatggcattagtggtacttgctttgaccgtcccggatttttagcaatgatgaaagaagtggaggccgggaatgtggagtatttgtgcatcaaggacatgagccgcatgggtcgtgactatctgaaagtcggtcagattatggaaatcctgcgtcagcgtggcgttcgccttatcgccatcaatgacggcgtggacagtgccagaggggacgatgattttacccctttccgcaacattatgaacgaatactacgccagagacaccagccgtaaaatccgttccactttccagtccaaaggcaagtccggcaagcacctcacaggcacggtcatttacggctatctttggaacgaagccagagaccaatggttggttgaccccgaagccgccgaggtggtcaagcgcatctttgccatgacgattgacggctacggtccgtatcagatcgccagcaagctgaaagaagaaaaagtcctcattccgtccgcttaccttgcccggcacggcgagggcgtgaacaaaaataagaccttcaaagatgtgtacggctggggttcttccaccatctgcaacattcttgaaaagcgtgaatatctgggacacaccatcaacttcaagacccgaaagcacttcaaggacaagaaaagccattatgtcccggaggacgaatggacaattttcgagaatacccatgaagctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgtaccaacaacggcaagcgtatttctcaatatacctgttcccaatacagcaaagtcccagttggaaagctctgcacgacacagcaccgtatcaatgaagatgtggtactgtcccttgtttccgaaatgctcaaagctattgccgagtatgcgaagcatgacagagccgagtttgtccgagtggtgcaggaagcgcagtccagccagcagacggcagaggtcaagaaacagcggatacgccttgccaccgcaaagcagagagtttccgagctggaagtcctgctctgcaaaatctatgaggacaacattttaggaaagctgtctgacagcagatatgccactctggacgctcaatatgaaaaggagcagaccgagcttaccgctgaaatctctgttctggaaaaggctatcaagagctacgagaagcacgaaaaggacgctgaccgttttatcgctctgattgacaagtatgagaacttcgacaagctgacgattgccatgctcaatgagtttattgagaaaatccttgtgcatgagcgtgaccgcaagggcagtattcagaccacacaggaggtcgagatttacttcaatttcgtgggtcgtttcgttcccccggcgtttggagaagtggagctgaccccggaagaattagaggaaatccgcaagcgtgaggaacgcaaggacaggcttcatcagaactacttgaagcggaaagccagcggagcacagaagcaatacgaggacaaaatcaaaaagcggaaaaaggcagaaatcgaagctaagaaagccgccattcgtgcggaggacattgcaaagggcgtgttcgttcctgtcagcagtttaccgcagagagagccgatgaaaggagtacaaacagcatgaatatcacttatacacagaacggcgattatcttatcccgaacatcgttatccgcaagaccaaacccctcggacactacggcagacttcgcaaggcgtatctggaaatgcaccgtccgatactgttcaatgagctggtgctatccgacaagctctttgagcattgcgccgagattgacgaagcggcacgaaatcgcatggagctgatcgtgccgcaactggcaaagcagtacggcgtgaccgaaaggctgaaagccgaaaaccaaatggaatgggtgcggcagatgaacgcttgcaaggcacaggcagaggagattgtgaaagcggaattgatttacgattgatcgaggaagtccgggcagaaaactgttcggacttttctcatatagtccaaagttgcggtagaaatgttcacaagttttatggtacaatttatgcgaataaagaaaacggaaaattagaatctaacaagagaatgtggttgtatgaaaaaatccatattagtattttgggcaatcgtgtgtctgttacctattcaaaggaggtttaagaattttaaatgaaacatataagaaatatattgctgttgattacgattatttttgcttttgttatgcaagctgaagtatatcaaaatatgctctggaactttaatggtgcttattatttatcgtccagatacacaactactaatgacgatatggattcatttttagccaatgcagaagatacagctgagaagcatggtgttcatattttttcgacttttaatcagagagtttctaattatcagacaagactttatatttatggtgatgataccgttgttcgggatagtcttaaaagcacaatggatattgaggaaaaaacatatacggctttgataggcggaatcaccgtaatagaatttgaagattttagagaagcaaaaaacacaggcaatggacaggaaataatggtcagctatatcggtgacgatgatgacattattgccacatatcaagatttggcaaaagaatattctatatcgcagccagagttttggcaatcaaccgaaactgatatgatgttcattgtttggggcctggttgccatattgatgattgtacttaatatgattgaggtgatacgcagacaaaaggaagtagttgtacgagcttctctgggcgaaaatgctgctgtgattgctctaaaagctgtagtggctgatatgatttcatatgctgcattattcgtcttagcaaagttgcttgtttctcaatttatatcgggagcgtatgaagatcatctcattttggcagtgtattgtgccggagcagttctttccgtaattccttatgctgcttttgtccgctttgatgtaaaaaaagcctttgccaatgcttcagataaaaaaggtatgttttatcttctgaacggtcttaaagtatttgctactgctatgacgatttttacaataactacaaatctcagtagcattcaaggtaatttacttacaaacactactcttttagaaaatcattataatgattactattttggagttatgcagattgaacctccttttgaagaaaatgaggaggaatccaaagagagcgaattttggaatgacctttacgaaaatgaatacaacactataaatccggtggtctgcataggcagccggataagcgatacggataattatatttttgtaaatcataatgccagagatatgctgcaagggttttctgatatgcttactgaagatgatgaaaaagaggatatcgtggtcttcgtgccaaagggaaaaaatgcggaatcatacaaagatatcgcaaaagaggaaattgactctcttacccaaaatgcagaagaactgcgtgttgtttataaagaatattctggcagagagcaattttattatctcaattcgaacagagaagaggctattgacggattgtcaagagcaacaaatccgattgttatttatcaggcaaatgaggctgttgctttgaatggaagttatatcgaaacaggaacatataatggtgaggtgatctacggatgcgatgaaagcacaattcgtaatgctgcgaaaaaatatgcagaacagcttggtccacactattttatgctgacgaatgtcggggaggattatacttatagtcatagtttcctcgtgaaactgattggctttataagctctctttgcgtattagtattgctgttagatatcgctatcatcatatctgaagtgaaaatggaatttagacttaatgcgatggaaatctccctcaaaaaggttttgggctatcgcttttatgaaaggcacaaaagatttatttccgttaatctcttagaaaatatagccgttgtgatattgatttgcattgtttcgctttttatatctaacgcaagtgtcgggattgctttactggttggagcattgctcaccattattgaaatggcaatcattttcacaaatgttatgtgggttgaaaaaacaaatatctcaaagtccttgaaaggtggatgtttatgattataattcgtggcttaaataaagcatttggagagaaaataattttctccaactttaatttggaaattccggatggaagttttgtagtaatcagcggggatagcggcagtggaaaaagcactttgctcaatatgattggtggtatcgaaaagccggatagcggcagtatcataatcgaagggctgaatattacccggcttaaaaataaaaacagtttttttgcggatacagtggggtttctttttcagaattttgcactgcttgaaaataagacagttaaagaaaatttaagtttgattaaaaaatcaagccgaactaaagtatcacttaaagaagctcttaatcgtgtggggttatcaaaggaagttaacaaaaaagtttatcagctttccggtggtgaacaacagagagttgctttagctcgtcttatgatgaaaaaatgttctgttgttttggcagatgaacctactggctcacttgacaagaaaaatagagatattgttatgaggttattgcacgaactcaatgaagaaggtaaaacggttatcattgttacccacgatcagggtattattgaagatgaaccttatgttgtgaaaatctgagagtacctcttagaaatgtcttgatctacattttatgtaatttgggtcagaagaaaatccctttaggaactaaagggcgcacttctatactctcctatcgggagtatgtgcgtcctgcggagcttcattcccggtcagcagagaaaaactgcttgaccgaaaatgtttcgtcacttcgttccgtcaagggagctacactcccttgcgacgcttgtgcgtctatcccttgtggacttgccgtccgcaaacagcatgaaatgctgttcgccgccagcaagtttggaaaaataaataccgaaaatcagaccgttgactggtcgcaatgtgcgaaaagttgacggtctttttttatcccaaaaatcaaaaaaggaggtcaatcacaatgacaaaaccgaaaaccctcgatcagcttcgagccgaaaaggaacgagctgagacgcagcttgcacaggagaagcacaagctggagcgtctggagaacagaaagaagtatctggagaaaggcgaacgcaccaagcgcacccaccgcctttgcaatctgggcggcacgattgagagccttgccccggaggtcaaagatctcacacgcaccgaaatgacagagctgatggaacacatcttttctctgtccgaagtccagcgagccgtccggcacatggcgattactcacaccaaccaagcgaacagagaaaaggagctgaaagccgatggcactatttcatctgagcgtcacgcagactaagcgaagcgcaggacagtccgctattgcttctgccgcctaccgtgccggggagcgattgtatagcgagtattacggcgaatacagcgactacacccgcaagggcggcgtgatctgctctgacattctcctgccgtcccatgcaccgcccgaatacgcagaccgccagaccctatggaacgccgtggaaaaagccgagcgtggaaagaacgcccagcttgcatacagctttgacattgccttgcagaatgaattttcccttgaggaaaacatcgctcttgcaaggcaatttttattggagaactttgtgagccggggcatggtggttgacttcgccgtacaccagccagaccgggaggacggcggcatacccaatccacattttcatgtgctttgccctatccgccccatcgagcagaacggcaaatgggggctaaagcaacgccgggtgtatgagctggacgaggacggcaaccgtatccgggaccagaacggcgagtttgttttcaacgccgttcccactaccgactggggcagtcccgaaacgctggaatactggcggcagacatgggcagagttatgcaacgccaagtttgcggaaaaggggcttgacgttcgtatcgaccaccgaagctatgagcgtcagggcgtagagcttcttcccaccgtccatgagggcgcaaccgtccgggcaatggagaagaaaggtatacgcaccgagaaaggcgagttcaatcgctggatcagagcgaccaatgccgttatccgggacattaagaagaaaatcgctctcctgtttgattggattgccgaagcaaaagcggagcttgccaagccgcaggcacccgaccttgtttctctgctgaacgcctattacacccagcgcagagccggggcttattcgcagaaaggcaaggtcagcaacctaaaggagatgaacgaaactttcaattatctccgggcaaacggcatttactcccttgaagatttggaacaccgtgtcagcgaacacagtgctgccacagagagcttgaagaaaacgctggacgaacagaccgcccgaatgaaagcaattaagcagctctatgacagctccgctgctttccagagcttgaagcctgtctatgacggcttgcagaaaatcaagtttgagaagcccagagccaagtacaaggcagagcatgaagcgaaactgaaacagttctacgccgccagacgaaagctgaccggagagttcccggacggcaaggtggatatgaaaaagctgaccgaagagtatgacgagttggaacaggcgcatgaaaccacctacggcgagttcaagaccgtaagagacgatttacaccgtctttggaaggtcaagtcatgcgtagatactgccacccgatttaacgagcgcgcagaggaacaaaagctccaaaatcgaccccaaacacgacacaaaaaggaggaactatcccgatgaattatacccaagcgcagattgaccgggcaaacgccgtcagtctggaagattttctccgcacacagggagagacgctaatcaaaagcggacgagaataccgctggaaagaacatgacagcttgaccgtccgtggaaacaagtggtttcgacacagccagagcaagggcggctatcccattgattttgtcatggagttttacggcaagtcctttcccgaagccgtccagcttctgaccggcgaaagcggcgaggggcagaccgaagccgccacagcaccgcccacagcgtttcacttgcccttgcacaacagaacagccgacagagcaatccaatatctcacagaaagccgaggtctcaacaaaacgcttgttgaggcttttcttctttccggggatatttacgaggacgcaaagcggcacaatgttgtgtttgtcggcagagaccgaagcggtacgccgagatacgcccatgtgagaggaacggcagacccattcagacaggacattgtcgggtctgacaagtcctatccgttccgatacgagggaaacggcaaccagctttttgcctttgaatcaccgattgacctgttatcgttcatctgcctttatccgcaggactggcagacaaggagctatcttgccctgggcggcgtttcgggcaaagcccttgaccgttttctttctgaacgcaaggacacccgaaaagtgttcctctgccttgacagcgacaccgcaggaagcgaagcctgtacccgactggcacagtccattcccggcgagatcgccgtcattcgccttgtcccggcaaggaaagactggaacgatgttctccgtcagcaaggggacattcccagccgcaaattcatagccgaaacaatcacgctgcgagagctgcccaccgcccagcctgttcccatgctccgcatggcagatgtggagctgacgagcgtggattggctatggtttccctatatcccctttggaaagctgacgattatacagggcaaccccggcgagggcaagacctactttgccatgcgtcttgcggcggcttgtaccaaccgaaagcctttacccggtatggagacccttgagcctttcaacatcatctaccagaccgcagaggacggtctgggcgataccgtcaagccccgactgatggaagcggaagcagaccttgaaagagtgcttgtcattgacgatagggacacaccgctgacccttgccgatgagcgcatagcaagggcaatccgggaaaacaacgcaaggctggttatcattgacccggtacaggcgtttctgggcacagatgtggacatgaacagggcaaacgaggtgcgcccgatattccgcagtctgggagacattgcacaggctaccgggtgcgctatcgtgctgattggacacctgaacaaagccgcaggaacgcaaagcacctaccggggattggggtctatcgacattacggcggcagtccgcagtctgctctttatcggtaagctgaaggacagccccacaacaagggtgcttatccatgagaaaagctcccttgcgccgcccggacagtcccttgccttttctctgggagacgagaaaggctttgaatggataggagcttatgacattaccgctgacgagcttcttgccgggacggacaccgccaagaccgaaagcaagaccgcacaggcgcaaatgctcattctggaactgcttgcagatggaaagcgtatgccgagcgcagagctggaaaaggcagtcaatgagcgtgggatttcctcacgcaccatgagaacggcaaagagccgtatcggggacagacttgtgaccgagaaagacggcaccgcatgggtctgctatctccgaaactgacaacaggaacacggcaagcgtggcaaagacggcaagggttttatagataccttaatgttgccgccttgccttgttccctcatactgacaccgcccgatgatgaacagtcaccgggcatttttcatttacaggaggattttgaatgaacaataccgcaaccaacagtaccccttgcccgactgtgagaaagcagatcggcaagacaacctatatcgtccgtgtgcatttcagcgagaccgccaaggagacaatggaggacaaaatcaagcgtctgctccgtgaggaagtccgcaaaatgtgacttctttttgaatttgatgaaaaagtccttgacttttcgtctctggcaaaaccgcgaagtcgatcctgatttcctgcggcgcaaggcttgcgcccttcgacatcgcagagctgcgggagctgatgagctacgatgagatggagctggacaccatcggagaccggaagacggcactgttcgtcatcatttccgataccgatgacaccttcaatttcgtcgtggcgatcatgtattcccagctattcaaccttttgtgcgataaagcagatgacgtttacaacggacggcttcccgtccatgtacgctgtctgctggacgagtttgcgaacatcggtcaaatcccgaagtttgataagctcattgccaccatccgaagccgggaaatctcggcgtcaatcatcttacagtcccagtctcagctcaagaccatctacaaggatgcggcggacaccatcacgggcaactgtgactgcacacttttcctcggcggaaaagaaaaatcgaccctcaaggaaatcagcgaggtgctgggcaaggagacaatcgacctttacaacacctcagaaacccgttccaacaacaactcctacggcttgaattatcagaagaccggcaaggaactgatgtctcaggacgagatcgccgtcatggacggagccaagtgtattttgcagcttcgaggcgtgagaccttttctcagtaacaaatacgacattacgaagcatcccaaataccggcagctctccgactacgacaagcggtacacctttgacatcgagaagtaccggcagcacaagctggtggtcaagcccgatgacacattcgacctctatgatatgggcgaggtcgatgcagattaaagccccgtcgctgcactgcgcagtgggtaaagcctgatggctcatcccaaagcagaacagcgacggggcttctttttttatgcccattttcaaaaatacacactcaactttcatcgattcaaggaggaaaatctatggctttcatcaatcaggctgtcacggttcttcagacgctcgttatcgccctcggcgcaggtctcgcagtgtggggtgttgtcaacctcatggaaggctacggcaacgacaaccccggcgccaatgctcatgtacggtaaagaagcaagcaaccgaaaacaatagatagaccgccagcactacactattccgaaccaaagaccaaaagataagcattttgagaaaatctaaacttttggattttcctacaatgccgactacggcggaatccctcccactccttatatatttctttctgtatacattgaatttgtatttagtaaaatgcagacaacaccacggatcggcttttggctggacaattccaaccaaacaccgcagcagacagtagaaaccattctgaacgttaggaagccggtatgattgttacatataaggggaagaaaaatttcttttagatacttgttttcctaaaactgatgtgatataataattcaattccagaaaaggagtaaaaaatatgcggcaaggtattcttaaataaaactataatcaaatagtgggaacaaaggattatgatagtcccttttgtaggggcttagttttttgtacccaatttaagaatacttttgccttatcaattttgacatatccccaaaaacagcactcacaaacaggtgtatgctgtatatgtgtatgtccgcaaattatcatccccagtggtaaaagtattttactgctggggatttttatgcccttcggggcagtaaagggaggataatcacatgaaaataatcaatattggaattcttgcccatgtagacgctggaaagacgaccttgacggagagcctgctatatgccagcggagccatttcagaaccggggagcgtcgaaaaagggacaacgaggacggacaccatgtttttggagcggcagcgtgggattaccattcaagcggcagtcacttccttccagtggcacagatgtaaagtcaacattgtggatacgcccggccacatggattttttggcggaggtgtaccgctctttggctgttttagatggggccatcttggtgatctccgctaaagatggcgtgcaggcccagacccgtattctgttccatgccctgcggaaaatgaacattcccaccgttatctttatcaacaagatcgaccaggctggcgttgatttgcagagcgtggttcagtctgttcgggataagctctccgccgatattatcatcaagcagacggtgtcgctgtccccggaaatagtcctggaggaaaataccgacatagaagcatgggatgcggtcatcgaaaataacgataaattattggaaaagtatatcgcaggagaaccaatcagccgggaaaaacttgtgcgggaggaacagcggcgggttcaagacgcctccctgttcccggtctattatggcagcgccaaaaagggccttggcattcaaccgttgatggatgcggtgacagggctgttccaaccgattggggaacaggggagcgccgccctatgcggcagcgttttcaaggtggagtatacagattgcggccagcggcgtgtctatctacggctatacagcggaacgctgcgcctgcgggatacggtggccctggccgggagagaaaagctgaaaatcacagagatgcgtattccatccaaaggggaaattgttcggacagacaccgcttatccgggtgaaattgttatccttcccagcgacagcgtgaggttaaacgatgtattaggggacccaacccggctccctcgtaaaaggtggcgtgaggaccccctccccatgctgcggacgtcgattgcgccgaaaacggcagcgcaaagagaacggctgctggacgctcttacgcaacttgcggatactgacccgcttttgcgctgcgaggtggattccatcacccatgagatcattctttcttttttgggccgggtgcagttggaggttgtttccgctttgctgtcggaaaaatacaagcttgaaacagtggtaaaggaacccaccgtcatttatatggagcggccgctcaaagcagccagccacaccatccatatcgaggtgccgcccaacccgttttgggcatccatcggactgtctgttacaccactcccgcttggctccggtgtacaatacgagagccgggtttcgctgggatacttgaaccagagttttcaaaacgctgtcagggatggtatccgttacgggctggagcagggcttgttcggctggaacgtaacggactgtaagatttgctttgaatacgggctttattacagtccggtcagcacgccggcggacttccgctcattggccccgattgtattggaacaggcattgaaggaatcagggacgcaactgctggaaccttatctctccttcaccctctatgcgccccgggaatatctttccagggcttatcatgatgcaccgaaatactgtgccaccatcgaaacggtccaggtaaaaaaggatgaagttgtctttactggcgagattcccgcccgctgtatacaggcataccgtactgatctggccttttacaccaacgggcagagcgtatgccttacagaactgaaagggtatcaggccgctgtcggcaagccagtcatccagccccgccgtccaaacagccgcctggacaaggtgcgctatatgtttcagaagataatgtaacgtcttgcgcaatgcaagcgttcattgctggctattgcgaaatatcattgataaaatcagtatcagagaggagaaactattttgaaccaggaacagacgaatattacaacaggaaagcaaatacgtcatctgcgaacacaattgggaatgacacaggaagaactagccggggaattgaatgttacccggcaggcactatcgaattgggagagagatgttaatgaacccgatttaaatatgttgaaaaaaatttgctttctttttggagtcaacatggacgattttgcgaaggaggtaataacaaagatggaaacatatgaaaaaaaggagaaacgacaatttaataagtacgatatggcaattggacttttttatggtgttggtatatttcttggcattggtattttctttgttggcggttttatgacaatgtcagatgcagggtggggagcatcactatttggcggtggctgtttttctcttgtatttggcttgatatgccatgcagttattacattgagaagaaatgacaaatgatgacatatcctgctttctatacttttcggtaataccgagtaaaaaaagccgctgcttttggctttccaatagcggcggcttaatgcaagcggcggcaaagggaaatatcctttgaataccttacagaagaaaagttttgcagcattacaaaaataaaagcctataccattttggaaagaaaagatacataatagtcaagacgacaacaatcagaagttatggagggtaacaatggaatatagtaaggaagatttaatggaagcaaaaaagcaaattttgggagtgggagagaacatgggaacagaggaaagtaaaaaaatctgggaggagaacgcacaattttgggataatgcaatgggtgacgaatctaatgaatttcacagagaggtagtgcgccccaaagtaacggaacttctatctcctaatcctgcggattacattttggatattgcgtgtggcaatggaaattattcttcgtatcttgcacaaagaggtgcttcggttgtcgcttttgattacagcaaaaaaatgatagaattggctaaaagacggcaatcacaatatgcaaaacaaattgaattttgtgtggcggatgcgaccgatagaaaaagtatattagaattaaaaagaaatcgagcctttacgaaagcagtttctaatatggcaattatggatattacggacattgaaccacttcttatggctgtttatgaactgttgcaggaaagcggaatttttgtctttgcaacgcaacacccttgttttgtcacgttgactgaaaaatatatgacaccgcacagttactatgatatagcgattgaagggcaaccgaaagagcagatttattatcatcgttccatacaagatatttttaacctttgttttagagctggatttgtcattgatggattttatgaagaatgtttcaaaaccaacaaagaaattcctatggtaatgatagtaaggcttaagaaggtaaaacgtgatagcttaaaataaattcaagtttgtcgggtaaatagcaaacccagccgagccagtcaacgataaaatgaacgccgcttcgcgccgtcgttgacagccccgcccgtctttgctggtaggcaatcaaggggcgacagcaaggagtactgccgccccgcactattattcagagagggggaatttccatgaccgaagatgaagcctacaaggtgcatatccagtacacattcaatgccttttgcaaggtagtcattcgtcacgcagccatagataaaatcttgaagctgcgccggaggtgggaacgggaagtttcccttgattatctgatgagtgaaaagtttgtccagcttgccgagccggagtagcttgaagaatatctttttaccgcctgcggccagaccgccgttctgtatcatgcggagcttgccgccgcccttgcccttttgccggagcagacgcaggaagaaatttttcgttactatttcctgcgccagccgcagcgagtgatcggcgtacatattggccggacacgcagcacagcggggcggcatatccggcttgccttgcagcggttaaggcggctcatggagggaaatgactatgagtaaacttctcccctatgaaacaatcgtcaaagcccatgagggcgacccggacgcaatcgacaccattctttcccactatgccggatatatccgctactgttccaaagtacacgggaaagtcaacgccgaagttgaggaacatataaagcaacagctcattgccgccctgttcaaatttcgctttgaccgataaacaaagaacaaacactggctgtcattagcggtttcactccagccagtttacaattcatctattcctaaaggaagcaggtcatagtataatagaaccaacgacaaatatacttttaggggagatatagcaatatgaaaagtaataaatacttaactattggcttattaacaggatttattgtcggtggttgcataggtgtgttggcatgggcgtttttgcaaaatctttttgctatttctatttgtgcaggtatcggaatgttgattggaattgttataggtacattgattgattatgaaaaaaataatcatcaagagaaatagaaaaaatgcacaatgccttaaagggaaaacaggaatttattgtgctatccatcatcgggccaacctgacctgaactttcaaaactgaatatccaccgcccatcggcggccagcgaaagcagtaagtctgaaaaagatttgctgcttttttctttatccgtttggcaaaatcgcaaagtcatccgtagtaggtaggtgaagccggaaacaaaaaattttctgcggcggtagccaaatctgcattttctgtatttctaaggcaaaggaaaatttgagaaaattcccggcaagcgggtagctggcggcctttgaaatgtatctttagcggaaagaaagaactgcgggtaaaaatcgccccacgccgtaagatttttgcagaaatccggccaaaacaggcggcagctatacgagtagtaagtgcaaggggaaatctacggcttacttagagcaagtttctaccacggtgccaaaatccgcaattctgcggttttgcccctcgcgggaaacttgttggggagtgccttccccaaaccctgctatgcggcttacgccgcaaaaatatttctgtccggcagacaggaaatgccccgaaaatagctaacagaccagcccattttttgtgataagtgaaaggaggtttacagcccatgccgaagcgatacaacaccccccaccgcagccatgttgtgaaaacccggctgaccgatgaagaatacgccgacttcacagaacggcttgcgccctatggtatcagtcagtccgaatttctccggcaggccatccggcgcactaccatacgccccgtactccatgtgtcgtcagtcaatgacgagctgctctccgctgtcgggaagctcacagccgagtacggcaggattggcggcaatctcaaccagattgcccgcaccctcaacgagtggcatagcccctacccggctatggcaaaggaattgcgggaagcggccgccgaccttgccgccctcaagtatgaagtcctaaagaaagtaggtgacgccgttggcaacactcaagcatttaggctctaagaacgccgactacggagccgccgaacaatacctgctctttgagcatgacgaatttactatgaagcccgtccttgatgaaaacggcaggcttatcccccgtgaggattatcgcttgtccacgctgaactgcggcggcgaggattttgccgttgcgtgtatgcgctccaatctccgctatgagaaaaatcagcggcgggaggatgtgaaaagccaccactatatcatcagctttgacccacgggacgggccggacaacggcctgaccgtagaccgggcgcaggcgttgggggagcaattctgtaaagagcatttccccggccatcaggcccttgtctgcacccacccggacgggcataaccacagcggcaacatccatgtgcatatcgtcattaacagcctgcggatagaggaagtgccgttcctgccctacatggacaggccagcggacacgaaagccgggtgcaagcaccgctgcaccgacgcagccctacgctacttcaagtccgaggtcatggagatgtgccaccgggaaggactttaccaaatcgacctcttgaacggcagcaagaaccgtgtcacagaccgggaatattgggcgcagaaaaagggacaggccgcactggacaagcagaacgcccccatgattgcaggcggtatcacgccccggcagaccaagtttgaaacgaacaaggagaagctgcggcagaccctacggaaagcccttgccaccgctgccagctttgacgagttttcctctctgctgttgcgggagggtgtgaccgtcaaggagagccgggggcggctgtcctacctcacgccagacaggacgaagcctatcaccgcccggaagctgggcggcgactttgaccgcaccgccgtccttgccgttttggagcagaacgcccagaggggcgtaacggttcgctacaccccgcagcaccaagccgccagagccgccgaacagaccgcagccatacccgaatacctacacgccgggaaaggccgcttacagggcgaaaagacagggaaaatcgaccccagacaggacagtgtgcagcggcttgtggacattgagcagaagatggccgagggcaagggcaaaggctatgaacgatgggcgaagatacacaatctgaaacaggccgccaagaccctgaccatctaccaacagtacggcttttcttccccggaacagcttgaagccgccgttgctaccgcctatcaggaaatgcgccagaccagcggcgaactgaaagcactggaaacgaagctgcaagggaaaagggagttgcggcaacaggtacttgcctatgccaagaccaagcccatccgcgaggggctgaaagcgcagaaatccgagaaagcccgcgccgcataccgccaggcaaacgagagcgattttatcatagccgaagccgccgcccggtatttcaaggcacaggggcttaccaagctgcccggccgaaaagcgttgcaggccgagatcgagcagcttatctccgagaaagacggcctgtacaacacctatcacgaacagaagcagcggttcagggagttgcagaccgtcaagcggaacatcgaccagattttgcgccgggaagagccgcaccgcagaaaggagcagagccatgaacgataagccgtcccgcatggactaccgccagcaccaggcagcccgccgccttgtgcatgagtgctgtaactacgacgaggggaactgcctgctgttagacgacggggagccttgcgtgtgcgtccagagcatttcctattccctcatgtgccgctggttccgtgtggctgtcctgccccttgacggggagctggccgcagccctcttgtaccgggggagccggaaacgctgcgcggtctgcggggcggcctttgtccccaaatccaaccgggggaaatactgccccggctgcgccgggtgcatgaagaaacgcaaagccgccgagagaaagcggaaacaaaggcagaaatgtcacgctttagagcctttcaaacccgcataaatcaaggcttttttcgtgggtgtcaaagggtatgcgatacatttatcctttccccccggaaatgccgtcctaatgcgtgacaaagcccaaaaacgacacaacacagagggaggtgatactatcgctgattatatcagggcagacaccacgctgcccgcctatcttccatacccccgtttcctgctgaaaatggagatttcacagaccgccaagctgctgtatgcgcttttattagaccgctccaccctgtcacagaagaacggctggcaggacggcgagggcaggatattcattgtctaccccgttgcggagatagcggaaatgctggacaagggttgtaccgccatcaagggagccttgaaagaactggacgcagccgggcttttagaacgggaacggcggggcttctccgcacccaatcggctttatgtgaaagtgccgcctgtcccagtggtacggttttccgaccaactgatggccggaaaagcgaccctcatacagtcggaaaagcgaccttatgacggtcggaaaaccgaccctatgatggtcggaaaaccgacccctaacaaaactaatataaacaacttaatagagaaccaaacaatgagagcgagtggggagccgcccacagcttatggccgatatgagaatatttttctgtcaaaggacgaatatgacgagttacaggcagaatacccggacaggctggaacggctgattgaggaaatgagccattaccttgccgccagcgggaaagcctaccagaattatgccgccgccttgcacagatgggcggccaatgacaaaaagggagccgtaaaacagggcatccccgactatacctgtatggagggagaaagcttatgacaagtgaaatcaaagatattttggagaacatgacaaccgccgccccggagatggaggactatatcggcgaggacggactgctttactgcggaaagtgccatacgccgaaagaagcctacttcccggagggtaaggagctgtttggccgtgaccgccacccggcagagtgcgactgccagagagccgcccgtgagcagcggcaggccgccgaggaacaccgccgccatgtggaagccgtggaaaatctgaaacagagggcttttgccgactcagccatgcagcaatggacattcgagaacgacaacggcagaaacccgcagaccgggattgcccggcggtatgcggagcattgggaagaaatgcaggccgaaaacatcggctgcctgttctgggggaacgtcggcaacgggaaaagctaccttgcgggctgtatcgcaaacgccctcatggagaaagaagtccccgtatatatgacgaacttcgccgttatcctgggcgacctctctcccggctttacaggccggaatgagtatatttcccgcctttgccgctatccgctgcttatcattgacgacttcggcatggagcgtggcaccgactatggactggaacaggtattccatgtgattgatacccgataccgcagcaacaagccgctgatcgccaccaccaaccgcccgctggacgagttgaaaaagccgacagacacggcccattcccggatttatgaccgactgctgtccatgtgcgtcccgatacgctttactggcgtcaacttccggcaggaaaccgcaaagcggaaaatggaaaccatgaagaaactgctggctgaatgaaaggagtattgcctatggagaatatcaagcagcacgaccaccgtaccacccgccgccccgactgcgtgacggaaatccgcatggggaataccgttcttgtcgtgtccggctttttcaagaaagacaccaccagcaccgccgccgacaagatggcgagggtactggaagcggaagccgctgctacacaaaaaaaggcgatttgacaagctgtaaagaagcagatttatcacttttaccgctgtacagccgcccctgttccgtggtacaatgaaaccacggaatagtggggctggctgtcggaaacggaggattttatgttaagacaagccacccaaaacctcattaccgccctttatccgagattgtcccatgaggacgaattgcaaggcgagagcaattccatttccaaccagaaacggattttggaagcctacgccaagcagaacggctttaccaatctgcgctggtacaccgacgacggctactcaggtgcgaacttccagcggcccggatttcaagccatgcttgcagacattgaagccgggaaagtcggcaccgtcatagtcaaggacatgagcaggctggggcgtaattacttgcaggtgggattttacacggaaatgctgttccctcaaaagggcgtgcgttttatcgctgtcaatgacaacgtggacagcgcaaacggcggcatggacaatgattttacccctctgcggaacttatttaacgaatggctggtgagagatacgagcaagaaaatcaaggcagtaaagaaagcaaaaggcatgagcggcaagcctgtaaccagcaagccagtctatggctatctcatggacaaggacgagaactatatcgttgacgaggaagccgccccggttgtccggcagatttaccagctttgccttgcgggaaatggcccgaccaagattgcccgtatgctgacggagcagcaaatccccacgccggggacgctggaataccgcaggacgggcagcacccgacgctaccaccccggctatgagtgcaagtgggcgacaaacaccgtcgtccatctgctggaaaaccgggagtacactggctgtctggtaaacttcaagacggagaagccctcttacaaggtcaagcacagcgttgagaaccccatcgagaagcaggctatcttcccaaatcaccatgagccgattatcgacacggaaacatgggagcgtgtgcaggagttacgcaagcagcgaaaacgcccgaaccgctatgatgaagtggggctgttctctggtatgctgttctgcgccgactgcggccatgtgctgtatcagcagcggtatcagaacaagaaccgcaagcaggactgttatatctgcggcagctacaagaagcgtacccgtgactgtacggcacactttatccgcaccgaccttttgacggcgggcgtgctttccaatctccggcaagtgacggaatacgccgccaggcatgagagccgctttgtaaagctgctcatccagcagaacgaaatcggcggcaagagaaagaccgccgcagccacgaagcagcttgaacaggcccagacacgcattgccgaagtgaaccgcattatcaagcggctgtatgaggacaatgtaagcggcaaaatcagcgacgagcgtttcatggagctgtcggcggactatgagcaggagcagcgggaactgaaagaccgggctgccgctttgcaggaggaactttccaagtcgcaggccgccaccgtcaacgccgagaaattcatggggattgtgagaaagcaccttgcttttgaagaattgacccccaccctcttgcgggaaatgattgagaaaatcgtcgtgcatgagtgcagctatgacgagaacggcacccgcaggcaggacattgagatttattacagctttgtcggcaagatagacttgccggaagcctaacgcctgacctatccgacacagccctaagtgccggataggaacggcaaaattttttacacttctattacttctttatcgcacattagcaaagtctcagggcatcaagcagctcatggctaattagttggaacaaaaaacgaaaggaaaagcacaatccagacggtatcagcggcagtctacaagaataaattgtgatttcacaagattggtgttataataagagaaaagttcctgccggggcagccgccccggtggtatggatagaaaggcaggaaaacaatatgcacatcagctataaaccactctggcacacactgttagagcgtgatatgagaaaagaggatttaaggcttgctgctggtatgacaacaaatatgattgccaacatgagcaaagagggaaagcacatcagcatggatacattagcccgtatctgcgaaacgctgaattgtgagattaccgatgtgattgagttagtaccagacgagcctacttccacaggaggtaaggaacatgagcgaattgaaaccaagaataacggaaaatggaattgattatattcttgtcggagattactacatcccagacttgaaactgccggaggaacaccgccccatcggaaaatatggacggatgcaccgggaatatttaagagaagtccatccagccagattgaacacattgatactgaccggagaattgtggacatattttgcagacctgaacgaacaggcacagaagcggttcgataccatcatggagcagatgaaagctgccgagggtgtgactgaggaattaaagcgtacctgtcaaatggaatgggtgcagcgttgcaataacattcgcaaccgggcagaagaaattattttgcatgagatgatttattcataacgatatggtagaataattatgataaatcgaaatctataaaggagaatattgatgaaactatttttatgttcgcacttttcaagtgtaggaagtctgataaaggaagaaattgaaaataagaaagtcgcatttattccaacagcttcgctgcgtgaaggctacatcggttatgtcggctcggctcgaaaattattcaaaaagttgggagcaatcgtaactgaaattgatatttcaacggaggcttattcaacgatacagtctgtttttgaaaatgcagatgtgatatattttaccggcggaaattctttttttcttatggaccagctccgtaagacgggagctgatgggctgctgaaaaaggaattggaaaatggaaaattgatgattggcgagtcggcaggcgcaattatatgcgctccaagcatccaatatatcgagcaaatggatgaaaagccagaggactactcacaagaagatgatgcagggcttgatttgattgatttctatgttcttccgcattatcttacagcaccatttaagaaagttaccgagaaaataatgactgagttttcggatttgaatctatgcccaattaacaaccgtcagggaattgtaattgatggtgaaggttcaaaggttatttgcaaagactaatttgaaaattcctgtttttgaaaccggaaaatcggaagctgaggggatagactattgagaacatatgagaataaagacgagcttaaaaacgagataaataaaagctttgcaaagtatatttcagaatttaatgatattcctgagcatttaaaagataagagagttgatgagatcgatcgaactccagctgaaaatcttgcttatcaggtcggctggacaactcttgttattaaatgggaatcagacgaaagaaagggtattcctgtcaaaactccttcggataattttaagtggaatcagcttggcgaattatatcaatggttcacagatacatatgcccagctgtcactgcaagaattgaaagacagattgaatgagaatatcaactctatttatgcaatgattgattctctgagtgaggaagaattatttaaaccacatatgagaaaatgggctgacgaagcaactaaaacagctgtctgggaagtatacaaattcatacatgttaatacagttgctccgttcggaacctttagaaccaagattagaaaatggaaaaagattgcactataacttccagcttgtctttcagaaattctaactgaataatcacagcacgaaccgctgctacatggaatgaagccaacaaaccatgcaacagcggtttttctttaccattttttcctctggctgataggcgttcccattttctttgatttttggagaatccgaatcagccagcgaaattcttcttccgataaatttttgtagttgataccgagttgcttgcagtaaagcattgccagtttttccaaacggctgcccttgaaattttcgacggcttccagattttctttcagttcatcggcaacggtggtctggggcgcactttcactgtcctttttgtgggattcccgaatatcccggataatcaggttgaggtcatccagaaccatgtggctgaaatattcatcatcactgatatgggcagcttgcagcactttcaaatgcgggtcatcttcgccggggcgataccgttcaatgatttcatgccggacggtatcaacaagtgcattgaggttttgaatctgcatggtggcaatcccgtccacataaatctcaatgtctgcaagaaacttgataaaatctttatgtgtggcaagctcacagagcagacggttgttaatccgaccgcttttcagaagtgcaaccatctcatcgttcaaatgcagctccgtcaatggcgtgttgatctgctccttgttctctgtccggcacagcagataatcaacggaaaccccatagaagtctgccagcgtgatgaggtttccatgattgatttccttaaaatcttctttttcataactgccaagggctgatttagaaatacccgtcagctttgaaagttcttccagatttaagcctttgtccttgcggagttcccaaaggcgttcctgtatgcttgttgctcctttcatgggtgcacgctcctttccggcggtttcattgttgccgtttaactggattatatcacactttccgcaatcgtggaaatttctgatttttacccctaattcctactttgtggacatacggcacagggcacaaaaatgttctatgatacaggtagttcatcgatggattattccaatcgaatgaccagcctgtgtgggatatgcttccccggcgatgtagcgccatgacttttggaagggatatggaggaaccctgaccgaaacgagcgtaccaaagggagcgatacgccgctgtgagattcaggggaggaacgacaccggggagaactggcgaactgacaccgaaatgataccgaaacacgacaatctgatagggggatagtctaccctatcgctgatacttcgggagattttaagcggctctatggctgtaattttgccgaaaatcgccccgaaaccatacacgaaaacgggaggaaacacaatatgccgagaatgagcaaaaagaggaagcatgagctttccttttacctcaatgaccgggggcgtgtcacttacaacgaattatgccggaaatgccagcatgggtgcaagcagagcttccgggcggttgtgattgactgcccccgttatttatccaaacgagcaaagaaaaaggaggaacacaccgaatgaattttgaatttatgacgatagacacaccattaccgccctgtatgccatttcccagagcgttgacaggatttccagtcagcagcaccgcaaaggtcatgtactgccggatgctggacgctatgctatccaaagggaaggaggacgagaacggaatcctgtttgtctgcttccccatcacagccattgccgcagtcctgtcccgcagccccatgacggtcaagcgttctctgaatgaactggaaaccgccggacttatcatgcgggtgcgtcagggcattggagaaccaaacaggatttatgtgctgataccgggaaaggaggacgctgcccttgcctgatacctcaaaactggaaaagctcaaccgggagttggaaaaaagcgaaaagaaactgcggaaagccatcaatgatgaaaaggcattgcagcaccagttgaagcagcttacccgaaaggaacggacgcaccggctctgtactcgtggcggtatgctggaaagttttctgcaagagccggaacgcctgacagatgatgatgtcatgctgctgttgaaactcatttttcacaggcaggacacgcaggaactattgaaaaaactgctggaacgggagaagccggaaaccccttagtttactaagggcgcaattatacaccacccagaggatggtgcattgcgttctccgaaggctcctcgccggagggctgtgattttccgcagccacggtctgctccaaatcatacaggggacgctacgcttcccctacgctggctgccgccagctacccttttgtggacttgccatctggggacaccttgcgttgcaagctgttcccagccgacaagtttcataaaatacgatatcttttcgataggcgatgcagtataataaagtcagtgacaaattagaagttgcgaaaggagaacaaaatgtggggagtatgtcttgatagtaacgccatacaagatggattatttcagaccgttattcaatacaaaagaaaagagaatggtgaagtggtgattatatccccaaaaactacatacaaactggatattaagcatgttaaagaattgtcagcacctccccaatatatttatggagaatgtgtttcccccgtttcccttaattaaagatattgttgggtaaaaaagaaaggtcagtcgattttgccgatgaagcggtagtagatttctacttcctgctcacggcttccgtcctcgcccttgacagcttcgtggacggttattttttcaattagagtgttcagaagttcggcggtcagctccacagggttgacatactgtttcatcagggcaatccacttttcagcgtccgctgcggtctgtacggcggcttccatcgtttcgtgaagctgccttattttggtttcaagctccttttgctcgttctggtacttctcggacagcatattgaagttatactcggttatgcgtccggcagaccagtcctcatacattttagcaaacagcccgtcaacctcggctttacgcttttccgcctttttcagctccgcagcctgctttttcttcgcagagtttctttctctgtcgctggcattgagcagccgtttcagcagcttgtcctcgtctttctgtgccagcatagaccagtattgcagtcttgcaagcacataggcatacagtacatcatagcggatatagtgcatggaacactggcgtaatccctgtccgtacttactgcaatggtagtgtgcatagggatttttgttctggctgtttacaccataagccaatgaccatccgcagtccgcacattttaccagcccggaaaatatttgcgttgtgccattcttctgtcgcctgcgtctgcttgcaatcagctcctgaactttttggaacacttcttcggaaatgatggcttcgtgggtattttccacacgataccattcttcctgcggcttccgcacctttttcttgttcttgaatgaaatgttgctttgcttgttgtgaacgctgtgaccgatgtaggtttcctctttcaaaatgctcttgacctgtgcaatcgtccacgcataggctttttctggaggcgcaccggcgtagatattggcgaaagtcccgtatctttcatagttcagccagccgggggtaggtactttctcctccaccagaatccgtgtaatgctggcggctcccctcccgtgtacggcaaggtcaaaaatcttctctacaatccagcgtgtttccgggtcgatcagaagatgaccttttttgtccgggtcttttacatagcccagcggtgcataggctccatagtgtgcgccattggcaaatcttgtgtgcatggcagccttgacctttttgctggtctgtcgggcgtgcatttcattcaggatgtttaagaacggggcaagctcgctttctccgttgatggtgtccacattgtcattgatggcaatgtagcgtactcccttgctggggaaatagatttccgtgtactgaccggtcaggatatagtttcttcccagacgggataagtcctttgtgacaacgcagttgattttcccgtcctcgatgtcatcaatcatcctttggaagcttggacgctcgaaatttgtcccgctccatccgtcgtcaatgtactcgtctacaacggtcagcccatgctctgcggcatactgcctaagcatcatgcgctgggtctggatactgccgctttccccctgtaattcatcgtcacggctcaatctcaaatatagtgcggtgttataaatcgttgtattgtatggttgtttcacggttaaaaatcctccttctaaaagaaacaacccacgcttatacaatactcgctggtacaagtatatcataagcgtgggctgattgacagtcgttattccgtattttttcaggaagcggtggcagcgtgctggatcacatcttccagcagactgtcaagcgacttcccatcctgtgcgaaatgctccgataccttgatacggactttccccatgacaaaatactgggtgccgtctttttcggtaagcagggtgccgctgtttttgttattgctctcgtttttgctttttgccataggcagttacctccataaatgaaatatgcccgacaagggaatgtcaggcaggtgtacagccgtagactgtctccatgtcaaccaaactgtgtcaaccggcagaaaagactttgaaaacaatccataggcgctctatgattactttttactttttctttgatttcttggttgacatggttgacaaaggagagaaatgccccaaatatcaggcttttccccgtcaaccggctgtcaaccgaagcgtcaaccaaactgttaaccggtgtcttttcagaatggcagttccatttgccgggcttcttcttccgtgatttcctgaaaaccgtccccctccggcgggtcttggttgacacgctcccagcctttttgagaaccgtatttcttataccgctttgggcttttgtaggctgcccagccctgtatgatgccgcccgcaatgccggtattcataatctcgcagattgcccgtgtctcccagtctgccggggaatttaagttccccagcgcttcttcataaagctgcttggagcataccctgtcaccggtgtagtcctccaaataggcgtagatcatgccagcctgtgtgtcctcctgcataaagtcctgctggtgggcgttcaggtatcggttcatttccatgctgaatgacagcttatacttcccactgcggtaaaccgtcatggcttccgcccacatctgttcgatatacgctctcgccgccgcttcatcgtccagtatgtgaacctccgcccgttccgggtacaccgtcacggggagaaagcgccggttgccggtgcggtcacggggtaaaaagtcctgccggttggtcgtccctccgaatacacattgccgcagccggtctgccgggtgtgtctcatacggcactttgtaggtttctttctggcggcttaagaatgacttgatttcctcaatactcttggcgttggctgtggcaatcatctccgacatctcgataatccaatgcccttgcagcttgcggtacacattttcatcgtccagttttttcaaatcgtctgaaaaccattcgtccctgcctgccagcagccggaaaaaggtagatttcccggctccctgaccaccaaccagacagagcatgacctcaaacttgctccccggtctgaatacccgccggatggctcccatcaggaacagtttcaaggcttcataggtgtattcgtccgtatcggctcccagaaagtgatgcagggcgtaacggatgcgctctgtgccgtcccattgcaggctgttcaggtaatccctgaccggatggtagcggttttcattggcaacaatcttgatggcgctctgcacctttttctcgctggtaagtccgtaattttcttccagatacaaaagcaggtagttcatgtccatgtcggtcagcgtggtactggtgcgctcccagcccagcggcttcacaatgtcaatctgctccgtcaaaaggttcaggcgcagcgccccacgaaacagcgggtcacgctggaacaccgtcaggcagtttcggatgctgttcttcacgccgcctttctgcgtcccctctaatgtctcccggatttctgctggtgtctgcgccggttccattgtgtccatcgtctttttgaccgcttcctgcgtttccggcggcaatctctgaaattcgctgttcaagccgcagcacctcctttccctgtgcggcgatcaacgccgctttttcttctatttctccgtataacaaaatatccaaaaggtattctgtgtagcttatcctctgcaacgcttccacaaaaagaggatgccagatggcatcctgcggctgtggggcgtatgctgttttccaatgctccaacaggcgcagataatcgcatagcacccggaaacaataccgttccgtttcctgaaatctctgctccgctgatttttgtcggggctgtgacctgttgtgacgcttcctatctggcggcgcattgccggatttctcataggaaacgccgaagtcctccgcaagcctgaccgcagcttcccgtttccccaatccatacagcaaagcggcaaagtcgatcacatccccggaagccccgcagccgaagcagtaaaagcggctgtccactttcatgctgggcgtgcggtcattgtggaatggacagcagaccatgccgtttcttcccacccggattccatagaatgaagcagcctgccgggtggtaacagactgtttcaccgcttcaaatacattcaaatgctccctccataaaaatgccggtagcggtaaagctgccggttatgtcatagctccatctcgtgtttctttctctgtacttcctgtggctgctctctccggcgcagtgcggtatctacggcgttctgcacctgccgcagccgtatgacttcctcccggagcggcttgtgctgcggagacagttcggcatactctgtttttaactgtgcatattcctgtttccatgctttcagggcaatgggttttccgtccagtttttctttcagaatacggcgggcggcataaaacagccgtaactccgcatcgtgggatgtttcaaatttctccctctgtttcttaaacttgatattgttcaattccgtatgaacaggttttagccgctggtaattctcgccctcccgtatcaattcctgcaattcctttatcctggcagatttctttttcatggagccgcttaatgcttcaaattcttcactgacagaggaaagacgctcctgcaaatcctctaatgtgagcagcttgttttccgtcagataattgacggcttcggcaaactgctttaagtttccggttctggctttattgctccatgcccctgcgttgcgctggttgtaataagcgatcagcaggtcggcaaggctcggtgtctggggtttggaaagttcttcttttacctctgccatccagacaaacagggctttgatcttcttcctcacatcctgtataagccggttggtggctttaatccagcggttcagttcccctttctcggtgcggatgccctttgcttccatctgccggacattagctccctcgtggacagtaggtatcaggtcaagcccctgccgcacataggaacggtggtcgatacgcacatccagccctttttcctcaaattttgtattaacggcagccgcccactgctcccgccagtgttccagcgtttccggctcatgccagtctgttgtatggacagcgttaaacatataatcgccgtttttatcccggattcggtttccatcttcatcaagaagatattcccgccgctgtttttgtccccatgtgccatccgggttcaaagggcgcattgttgtcatcacatggaaatgcgggttagggatgccgccgtcctctttctccgggttgtgaaaagcaagatcggcaatcatgccttttgccacaaactgctcctgcacgaacttccttgccagctccatgttttcttccagcgtcaattcattctgcatggcaatatcaaaggaataggcaagctgtgcttttggatgtttctcgcagctctccacagcattccagagggtcgcccggtcaagatatatttccggcgcatggggcggcagcatgatttccgaagcaatcacgccgccctttttggtgtaatcgctgacttctccatagtagctgctgtaaagacgctccccggatcggtaggctgcgcttgcaatggcgctctgaccggcgctacgctttatctgtgcgattgaaaaatgataaagtgctatccttagtcaccgcctttctcctgcccggaaatacgggcgtggttctcagtggcagaccggatgaaatgctccgcctgcggcagattcaaaatgttttccatgagggaataaaattccgcttcggatagctcctttgtctgtggcgcaatgctctcaacggctgccccacgggtaatcagccggtgcgtcctctgtttccgggaaccgctttccagatacgcctgccggtttttcaaacgctgcattctccgtttttcccgttccagcaggacagtggttttttcatattcctgctttaactgttccaaagatttttccatgttctcacatcctttgcttataagataaagaaagaccatccgcagacagtctgtgtgtcagtgcttctataaaacccgatgaaaagggaaaaccgcagagcggatttctcttttcggcgggtacacaggggatagccgctttagcggcgcaaggggttgtagccaccttgtcggagcgaagcgaacgcggacctcggattgctgattttatcagcggcagaggtaagctccgcaggacgcacgatacatggtctttagactatgtatagaagtgcgcccttagttcctaagggattttgccgtttccggcagtcttgtcctttttcttggaacgcttggaaagatacttcgggcagtcaaccacaaccgcccggaagctctgtttacattcatgctggcatttccggcacagttcgttgtaagtgatacggctgcggtcatttaagaagaaagaccattccaaccgccgcttgttactcattcttgccataacaggctcctttctccgtttttatctgatgtacgcagataggctgttttggtgtagcgtctcggtatcatttttaaggttttttccctctgtatgcccctttggaaagtgcggcagtattgcaagtcagggaatgatacctcacgcttatttgtcgcttcccggtgcggtttcggagccttttgccatccattcaaagaaagcaattttgctgaccttgataagcctgcccctgcggaacgccggaaagccgggtgtgtgtaccagctcataggcgctcgctcttgaaattcccataatccgctgaatgtccgccacatccagaaccagcggtaaatcctcgtagctgttcaatctctttttatcgttcattctgttcctcccataaatcaaataggttaaaatgcttcctgttgccgttctccccaaaagccgttttcctgccccattcctgcgatgtttccctgcattggtgcgccggatgcgtcacttctcctgccggtcatatcccttttggacggtcattcacttgtcaagatactgtgtggaacgaaattaccaactgcaatcatcatagcggactatccttgacaaaacaatgctcctgcgataccatgagtgtaactaatataactaaattatataattaccataaacaaaggcaggggatagggatggagaatctgtttatacggcatgagccatgttttgagaggattttgtttgtcctgacgctggacaggaagaaaatgaaagaacggattttgattggggaagaacagcagatccgcttccggctgaacgggagccaaaacgcagaggtgctttgtgatatgacacgcccgctgggaacttttttgataaactttgagcgtgacacggacagagattggaacttatacgggctttctccactgcggcaagccctccactccaaccgatggaaacagccggagctggagcaggcggcaagcaaatttctctggggaaaatatcttagcaatgaccctctgaaaatgtatgtggcgttccgtatctggaacagctatctgcttgccagagaaccccgtgaccgtaacgctgcctgtgaccgcttcatggataaaatgagcagcctgaccggggtattccataacgaaaccatgagctttgacagggagacaggaaaaccgaaacattttcaagctggcagcctctatttcaaaggcgcaccgtcagaagatacccggcttgacctctggttcccggacaaccggcgcacagaagaatgtgtgtctgcctatgcgtccctctacccgttgattacctattatctgaacaggctgaatgactgggggctttgcttccggcagtgcaaggtctgcgggaaatattttctggcaaagagccagcggtatgagttgtgcagcgataagtgccgcaaagcacaggcgcttcaaaacaagcgggaatttgacgagagggcaagagaaaataactatgacctgctttataaaaatgaatgccagaactggcgcaacaaaataaaccgggtaaaaaataccgcaggctttccggctgaccgtctggaaaaaatacaggctgccttttccgactttaagaaagaagcattgcagagaaaaaaggctgtaaaaacaggaacagccagcccgaaagaatttacggactggctgtatcagcagagtaatgtaattgtggagctgactgaatactaatttttttctcgttgtgaggtttctgtgacatttgcctgatggcagtatcgaaattgcagtaattactcatgcaaaatgcttcttcgttttatacactatacctatatggtggagcaccaaatgaaaggagcaaaaaatatgtctgcaattcaaaatgcgattgaagtgaggaacttaacaaaggtttttagtggcagggttttgtttgagaattttagcctgaatgtaaaagcaaatactattcatgcgattattggcccgaacggttctggaaagaccacactgctgcgcttgattacaggggtataccagccaaatgcagggacaatcaacattgcagggaaatatgcaatgcagcttgaaaatgactatctgtatgacgaaaagactggccttgaaaatttgaaaatttttggaaaatactttggatttgaaataaatgatcgttcagacggctattgtacgcaattaggattgaccgagcatttaggaaagcgtgttagcacttattctaaaggaatgaaaagaaaactgtcccttttgattgtgattatgatgggacgggatattctgctcatggatgaaccaacatcgggtgtagaccccatatccagagtagaaatccgtagtttgatagaggctctaaaagctgacggaaaaacggttattatcacttcacatgaccttagcgagattgaaaagtgcgctgatgatgtatctatgattaaaaatggcagattgctgtttgataagggtattcaagaaatgcaaggacaatcattggaagaaatctttattaaggagggcaatcggcatgagtaacatgggaaaaggcgcaggctactatcttaccagaagtaatagcctcctaattgatactgcgattgttgccattctggcgatttttatgagctttgcaatgcagatggacgccttgcagtctaagggagaagattatttagtcctaatgctctatgcggttatttttggtcttacctccctgcaatccggtgctatgattgtagatttgacagcaaaggataaggtaagccggagaattgaattttttgcagcttctggaattgcggtaaaagagattataaaacagtattcgatacagattttccgcttttctggtattatcccgttctttgtttttatgagttgctattactttaccgactggacaatgagctttgggcggatcgtatgcgtttatcttagtattcttgtacttagtttttgtgagattgtcgctttgaatatcattgtactggatgtgaaacgagtaaaactgttcaaaaatgttctattctttggtaattttgcactggtttatttgattgcgatgtcggcagaacgaattacagagtttgtgaatcaacatcatataggaattgactatttgattattgtggttgatgttgcactttgcatgatgtttgcactattaagtttctttaaggctcggcacatgagcaacgaagcagttatcaggagggatggcgaatgggtttgataaccttaaaccttaaaagggtattgaactggaattttatatttatgagtgcggtagcagctatcttcggcatgatctctctgatgaactttggggatatttcagagaacattgtatttggcgttgatataaagtattttatgcttgatggatacctgtgcttatttatcttttttgccggagaaataagcaaggatatgttgcagcaagaaaaaatcacaaagagaatagaatggaaacttgctaatggtattaaaatctcaagtattgttaaagagaatctgctatcactatggattggaacgctgatccttttgtttcctctacttttgatgatttccattcgtctgccaaaccttatcttgttattaggcacctattttctgatccttagcgtattgtattcggcatttataaatgttttgattctctggattagaaatatgaactggtttaagagtattcctatctttgcaacactgcttcatattttgctggttgtcttaaaatgtgggatatttatgaaaacgaataatgtgtgggtgttgctactattttctccagtgagtataatagttttgactgcgtgtggtttatgtctgatgaccaaagaacggatcgtatcatcatattactaacataatgaattttagctgaaaggaggggtgtcctatgcaggataaacgcttctatccgtatctgcttcttcatgcgggtattgtgattttatgggttatattggatagaacacataaaggaattgcgaatgacggagccatcaacttattgtcgattgccgtcttgctttgttatttcaatctgctctatcttcatgtaatgacatcacggcgaaaggcaacaatatctgaatgtggctggaacctgttttctgtttcctttattgcggcgctgatgtatgatggattttctaccttatacacgggtgcatttctggcttttgcattgattatcggaataatgctggtaagaactgacgcaagccggggtaaaatggttcgcttgctgtttggaattgcggctatcatactgtcgtttttcaatttccaaattctccctgctataactatgttagttggaatgttcatgggaattttccttgattatagatatataaatttgaaacaggttaatattcttccgattgcccagaggaaagcaagatatgtcctcgcttttatgattcccttgtttacagtcgtactttattgctttgatttgtccaccctacaagtcaatgtattttttcagcttataatgcttttatttgaggcctttgctgtcattcatcttggcgacatggaggcccgttacaaggagttgacaaagtattatgaattaacgaactatattgcaaatgagagggaagatttctcaagactgcttcataacgatgtgcttcaagacattggaggtgccaaaaatctcctgtcgcttcgctcaccagatgttgatgaaacaaaaaggatattgtctgatttggaattgcgggtaagaaatatgatgaatttctattcctctaatatcttttcggggtatgcttcatgggaacatatcggatatatgcttgacgcgattaagaagctgtacccaaagaagaatatacttgtagatttcacgattgacagcgaagcaaggattgctttgaaaaaagataacagtttggaacagaccatgcagataatcaaagaacttgtcaacaatgtttataaacacgctgccgctacttttatccatttggaaatcgcgctaaatgaagaaagtaaactcgtaattacctgtcaaaatgatggagcgaacccaaatgacattgaaaatattctttcttccaaaggtggtatgctgttcttgacggtgttgataaatgggaatggtggtaacattcagtatttagagaaagatggtattttaactgcaacggcagttttggggagaaaaaatgaagatattactatttgatgatcacaggatatttggagagagtttaagcaaacttctggaagattgggacgaaatctctatctgtcgctatgtaagtaatgaaacagagttttggaatattctttccgtagacgaatgggacattgtattacttgatgtcaacctaagagagcagtcaaaaagttctggcattgatctgatagaaacgatatatagtaaaaagccaaaaataaaggtggttatgctatcctcttatgatatgccggtttatagacaggaggcacttaaaagaggtgctgcaagttatattgacaagtcggcttctgctgatgagctggtaaaaaaacttacagctattagtaaaggtcacaaatccactacgccccctttattagatcccctgacagatcgtgaagcggaaattattaaggcgattggaacagggaaaacaaagcatgaaatagcgcaagaactgtatatcagtgaacgcacactttacaaccatatccaaagcatctatgataagctgggggctaaaaatgctatcgaagcctataacaaggctattgcacttggatatatcacacccttaatatgagtttaggcaataagagggacagatatatcagaacacaagtgacaagtatgcacattatgtaagcagatagcaaaaacaagtatcattgaacgacttcatcaaaacaataaagaaaagctgggagcaaaattaagtctgcttccagcttttttgtatttgctattgtatgtggttgactaaggaatattgtttaagcgtgagtttgtgatattgggtgtggtatctttaactatgggaaactccttgtaatcatcccgatatgataggtatagtttgtgatattgcttggcatttcaagttaaactgctatttctatataattaaagtcaatggtagaccgaaaagcaaacgatactacgatggtgatttgaaccctattgtataacttccagtttgacgctctccccacacatcgggacaacttgtcccgaactttcaaaactaaatatccgccgctcacacagcggcataccaagcaggaaatctgaaaaaggtctcctgctttttttctgtccaaaatcggaaaggagggacacgaaatgccctgtccacacaatgaaatttccatcgtccaacgtagcaaccgccagtctgctgttgccgccgctgcctaccaaagcggcgaaaagctgttttgtgaatacgatcaagaagtaaagcattacccggaaaagcgtggtatcgttcacaacgaaatcctgcttccggcaaacgctccgccggagtacgcagaccgcagtaccctctggaacgccgccgaagctattgagaaacaatggaactcccagcttgcaaggaggtgggtgctttccatccccagagagataccgcccgaccagtacgccgcccttgtccgggacttctgcaaccagcagtttgtttccaaaggaatgtgcgtggattttgccatccatgacaaaggggacggaaacccacacgcccatgtcatgctgactatgcgggcaatggatgagcgtgggaaatggcttcccaagagccgcaaggtctatgaccttaacgagaacggggaacggataaaacttccgtccggcagatggaaaagtcacaaggaagataccgttgactggaacgaccgcaagtattgtgaaatctggcggcatgaatgggaggtcatccagaaccgctatctggaagccaacaaccgcccggagcgggtggatctccgttcttatgaaagacaggggcttgatattatccctactgtccatgagggggctgctgtccggcagatggaaaagcgtgggattcagactaacatcggaaatctgaaccgggaaatcaaagccgccaatagtcttatgcagtccatccggcagcttattaaaaacctcaaaggctggattacggagcttagcgaaaagcggaaagaactgcttgcggaaaaagctgcggaggaagcggtctttcttcctaatctgctgatgaagtacatggaggtacgaaaggcagaacggagcaactggacacgggcaggacaaagccgagggacttcccaagacttaaaggcagtcagcgaagccttgtcctatctccagagaaagggactttccaccgtggaggatttggaaaactttatagaaacgtccgggaaatctgccgccgactaccgaaagcagatgaagccaaaggaaacccgcagcaacgtgattgacgctatccttgccgcccggacggactgtaaggaatgtaagcccgtttatgagaaataccagaagatatttttcaagaaaactaaggaaaaattcaagctggaacacccggaggttgcccggtttgagaaagccagtgcctaccttgccaagcacccggacgataaggacagcacgaaaaaggagcttttgcaggaacaggcgaaacttgtgggcgaaatcgcagacttgaaagtaccgttgaccgaggtgcaggaagatttgaagaagctgcgggacatccgctactgggtacggaaagccacacccggcacagaggaaagcaaagagccgcccaagaagcagcccctcaaagaagtcttgcaggataaggctgacgagaagaaagcacagaaaaacacaccggcgcagacgaaacacaaacaacagtatatggaactttaacaggcacttgccattttcagattgagaatgataagtgccttttcttttttacaaggaggaattgatttgaatgtatttgaagctgtgaagcagtccgttacgacaagacaggctgcggagcattacggaatccgggtaaacagaaacgggatggcttgctgcccgttccacaacgataagacccccagcatgaagctggacaggcgtttccactgcttcggatgtggtgcagatggggatgtgattgattttgtagctgccctgtacgggctggggaaaaaggaaaccgccgcacagttggcgagtgacttcgggcttgcctatgaggactggaagccaccgggcagggcaaggaagcccaagccccggcagaaatccccggaagaacagttccgggaagcaaaggcacattgcttccgtgtccttgccgattatctacacctcttacgggcatggaaaaccgactatgccccgcactccccggaggaagcgtttcatccccggttcgtggaagccttgcagaagcaagcccatgtggaatatctgctggatgtgctgctgtttggggatacagaggaaatcgcttcactgattacggaacatggaaaggatgtgatacagcttgaacagcgaatggcagagcttgccgccgcagacgcagcaagaactaaaaaataccatgaacgccatgcagccgccccagagcgttgaggaagtaaaggcaactctggaagccaccgagaaaggcggcgtccgccagagcatacggaactgcctgaccgtattccagcgtgaccctgtgcttgccggggctatcgcatacaacatcctgactgaccgcaaggacatcataaagcccatcggttttcacagagaaagcacagccctgaccgatacggacatgaagtatctgcttctctatctggaggaaacctacgggcttaccagtgagaagaagattgagaccgccatcggaattgtggcgaatgagaataagtaccaccccatccgggattttctgaacagccttgcatgggacgggacggagcgcatccgcttctgtctccggcactttctgggggctgatgtggacgattacacctatgaagccttgaagctgttcatgctgggggcgattacaagggcatttaagcccggaagcaagtttgaaatcatgctgtgtctggtaggcggtcagggggctggcaagtccaccttcttccgtctgctggcagtccgggacgagtggttttccgatgatttgcggaagctggacgatgataacgtgtaccgcaagctgcaaggtcactggataattgaaatgtcggaaatgatggcaaccgccaatgccaagagcattgaggaaatcaagtcctttctaagccgccagaaagaggtttacaaaattccctatgaaactcacccggcagaccgcccccgtcaatgcgtgttcggcggcacttccaacgcccttgactttctcccccttgaccgttccggcaaccgccgatttatcccggtcatggtgtacccggagcaagccgaggttcacattttggaggacgaagccgcttccagagcctatatcagccagatgtgggcggaagcaatggagatttaccgaagcggcaggttcaagctgtcattcagcccagccatgcagcggtatctcaaagaacaccagcgggattttatgccggaggacaccaaagccgggatgatacaggcttaccttgataagtacaccggggaaacggtctgctccaagcagctctacaaggaagccttaaaccacacctttgatgagccgaagcaatgggaaatccgggaaatcaacgagataatgaaccagtgcattaccgggtggaactacttttccaatccgaggatgtttgcggaatacggcagacaaaagggctgggagcgtgaaatcccggcaacggacaccgacaacccgcccgaaaaatctatggacggttttgtggaggtcacagagcagatggagcttccattctgaaaatgacagcccgttgccgacttcgttgctatcccgttgccgagccggttgccggggaaaatcccttatttccgggctttttccctctctgacaaccaaaacaacagaaaaataaaagaaaagtataaatagtaatcaacgccagattgagattgtttgcaaggtcttttgaagcccgttgccggacttcgttgccgacaccctctgtctggctattttcatgtgcgcaggcaatgagccaagcggatatgcttgcatatccatttggcgaatgctgcgacaacgatagttatggaggataactgcctatggcgaaaaataagaccaagattgaagtgacaaccgtatttgacggggaactggacgccaccgatgtgttcgtcagcctgatttcccagaaatacggcaagacaaatacaaaagaatatcttgctaaaaagaaagatttgaagtataatgaagatgaggttcaacagagccagataccgtctggattgtgtgggtaaatggctatgatgaacgaaatggaatacagaacaatcggttcagcacttgccgggggctatcgtgcggcggtctattgcaggctgtcaaaggacgatgacctgcaaggcgaaagtgccagtatcgcaaaccagcgtgatatgctggaaaaatactgcgaaaagcagggatgggaggttgtggcagtctatcaggacgatggcttcacaggtcttaatatggagcgtcctgatttacagagaatgttgagagccattgagcgcaggcaaatcaaccttgtcatcacgaaagacctcagccgactggggcgtaactatttgcaaacagggcatttgattgaggactttttcccaagaaacggtgtccgctatatcgccatgaatgacggtatcgacaccctgcgggataacaacgacatcgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctaaacggtcatggtccgaactatatccgcagacggctggaggaagaaaaaatcccctgccccacatggtggaaccgggaacgggggcttcgcaatacccgcaccaaatgggaaaagaaagacccggaaaacgggcggtatatgtgggacttctccgttatcaaagaccttttgatgaatcccgtttacactggggcgattgcttcccagaaaaaggactaccgtttcaaaatcggcacgattggggaaaagaagccggaggactggattgtagtggaaggacagcatgaaccgctgattgaccgcatgagctttgacattgtgcagaacaagctgaaatcccgccagcgtccggggcagaccaatgaaatcagcctgtttgccggactgataaaatgcggcgagtgtgggaagtctctgacggtacgctacacaaacgcaaaacatccccagcagatttactcctgcaagacctacaatgcctttggaaagaaccactgcacccagcaccggattgattatgacaccctttacagtcatgtgctgcggaaaatccgggaatgtgccagagctgccctgatggacgggaaagcggttgctgaccgcctgaccaatacctgtgaagccgagcagcgggaacagcgggaagcaatggaacgctcccttacaagggacgaggaacggattgaggttctggacaaaatggtaatgcggctttatgaggatatgattgcagggcgtatcagtgagcagaacttcaacaccatgctggaaaagacacagaccgagcagacggaacttaaaacaaaagtgtccgagggcagaaagcggctgtccgatgaagtccagcttgccaatgacgcaaaacaatgggtggaagccattcaggaatatgccaacatcacagagttggacgcagccaccctcaaccgcttaatcaaagaaatcgtcgtgcatgagcgcattgacgaagataaaacaagacacatttctatcgaaattcattttaatctcaaacccatcccggaggtggaacaggtcactgcctgacctgtcccgccgggacggttctcttaaaaacaccatatagattttttgtacgccgccgcccgccatcgagcagagttttacacctaattggggattaaacagctcatggctggcggcggtgtggtgctgatcggcacgaccctcatccccctgctctccggtttgttcggctaatccacggcaagcccagcttaaccgaagggtggtgaaatattgggcagcattttagaaaagatcgaacaggctctcaaggatatgctgatcggatggatcgagagcaacctgaccaatatgttcaccgatgtcaacgagaaggtaggaacgattgccgccgaagttgggcaaacaccgtccggctggaacggcggcgtgtaccagatgatccggggactatccgaaaacgtgatagtccccatcgctggtatcatcatcaccttcgttttgtgctacgagctgatttccatgatcaccgagaaaaacaaccttcacgacatggacacttggatgttcttcaagtggtttttcaaggcggctgtggcgatctacctcgtgacacacacgtttgacatcgtgatggcagtattcgacatcgggcaggacgttgtttccggtgcagcaggagtcatccacggaaacacgagcattgacattgacgcgacgattgcgcagatgcgtaccggcatggagaacatgggtgtcggtgaactactcggactgtcgatagaaacgcttctaatcagcctgtgcctcaaaatcatggcgatcctcattacggtcattctctacgggcgcatgattgagatttactgcaccgtgagcattgcgcctattcccatcgcaaccatgagcaaccgcgaatggggcagcatcggcacgaactatctaaaaggtctgttcgctctggcatttcagggcttcctcatcatggtctgcgtcggcatctatgcggtgctgatcaacggcatgattattgcagacaacattcactcggctctgttctctgtggcggcgtacacggtcattctgtgtttctcactgttcaagaccggaagccttgcaaaatccatcttccatgcgcactaaggaggtcggcagcatgaagaagtacagcatcatctacgccgatcccccttgggcgtatcggacttactccaagaagggacagggacggtcggcggaaagccactacccgacaatgtgcattgaagacatcaaggcacttccggtcggtgagcttgccgctaaggactgcactctgtttctctggatcacgttcccgtgcctctgtgaagcgctcgaagtgctgacggcatggggcttttcttataagaccgtggcttttgtatgggtgaagcaaaaccgaaggaacgacgatctctttaccggcatgggctactggacaagggcgaatgccgaaatctgcatccttgccacaaaggggcacccgaagcgagttgacgccggtgtgcgtcaggtcatcctcagccacatcgaagagcattccaaaaagccggatgaagcacgggagcgcattgttcggctcatgggagaccttccccgcgtggagctttttgcccgtcagtcccccgaaggctgggatgtttggggcaacgaggtcgaatgcacggctcgtcttcccatggaggaaacaccatgctgcggctaagacccatctctcttcgagacgccaacgagtatgtccggcagcatcaccggcatcacaagccggttgccggtcacaagttttccatcggctgtgaagcagacggtgagctggtcggtgtaatcatcgccgggcgtcccgtcagccggtatctggatgacggcttcacattggaggtcacaaggctttgtaccaacggagcgaaaaacgcttgcagctttctctacggcgcggcggcaagagctgctgcggctatgggctataagcgcatcatcacctacacgctggaaagcgaaaacggtgcaagccttcgggcttccggctggatctgtcaaggcaaagcgggtgggcttcgctggacgggcaagcgtcaaccgaaggaggatcaatatcccgcacaaatgaaactgcgctatgaaaagcagcttagaaaggaggaaacagtcaatggcatttgttccggtcccgaaggatcttaaccgcgtcaaaacgaaggtcatgttcaacctgaccaagcggcagctcatttgtttttccgtcgctgcggcagtcggcgtcccgatcttctttctggcgaaggcacatctcgacttgtctacggcggcaatgctgatggtggtcatcatgctcccgttcatcttcttcgcgctttacgagaaggacggacagcccgccgaaaagtatctgtaccacatcgtacagtccatgttcatccgcgacaaggttcgtccctatcgcacaaacaatctctacgctgagattcagcagaaaatcaaagaacaggaggaaatgcagcttgaacaacagcacagcaaaggcaaagcctaagatgacggtcaaaaacggcgtcgtttacggcgacgccctttccgctcaggaaaagaagcggatcgtcatgcagaagaaaaaggacaggaaggcaaagaaagtccgcaagtccgcccagcagaccatcccctatgtggagatgtgccgcgacggtatctgcaaggtgaacagccgcctctacacgaagtccatcgcctttgaggacatcaactaccagcttgcgcagaacgaggacaaaactgccatctttgagaactggtgcgactttctgaactacttcgacagctcgatcttcgtccagctctccttcatcaatcagaaggcaagcctgaatgagtttcgcaagcgcatcaacattccggcacaggaggacgccttcaacgacatccgctccgagtattccggtatgctgcaaagtcagctcaccaagggcaacaacggactggtcaagaagaagtacatcaccttcggcattgaggcggactccctccgcacggcaaagcctaagctcgaacgcattgaaaccgatattctcaacaacttcaaaaccctcggtgtgagaaccgagccgctgtccggctatgagcggctgaaagtgcttcatgatgtgttcaacatggacaccaatgagccgttccgcttttcctttgacatggtagcccggacgggactcagcacgaaggacttcatcgcgcccacttcctttgacttccgtgaaggcaagtgcttcaagatgggcagaaccatcggcgcggtgagcttcctgcaaatcctcgcgccggaactcaatgaccgtatgcttgccgacttccttgagatggacagcaacatcacggtcaattttcacatccggacgattgaccaggcgaaggcaatcaagagcatcaagatgaagatcaccgacctcgacaagatgaagatcgaagagcagaaaaaggcagtccgctccggctacgatatggacatcatcccgtccgatctcgccaccttcggcggtgaggcaaagcgtctgttgcaggatctccagacccgcaacgagagactgttccttgtgaccatcctcatcatgaacacggcaaccaaccgccagaagctcgaaaacgcggtgttccagaccgccgccattgcccaaaagtataactgtgcgctcaagcgtcttgacttccagcaggaggaagggctgatgtcctctctgcctatcggagtcaatcaggtggagatcgaacgcggactgaccacttccagcacagcggttttcgtgccgttcaccacgcaggagctttttcagggcggcgaagctctctactacgggctgaacgcgctgtccaacaacatgatcatggttgaccgcaagcagctcaaaaaccccaacgggctgatcttgggtacacccggttccggtaagtccttctccgccaagcgcgaaatgacgaacgccttcctcatcacggaggatgacatcatcgtctgcgaccccgaagccgagtattttcccctcgtgcagaagctcggcggtcaggtcatccgcatttcgccggtcagcacggattacatcaatccgctggacatcaacacgaactactccgaagaggaaaacccgcttacgctgaaatccgacttcatcctctccatgtgtgagctgattgtcggcggcaaggacggcttgcagccggttgagaagaccatcattgaccgcagcgtccgcatggtttatcaggagtttcttgcagaccccaagccggagaaaatgccgatcctcgaagacctctacaacattctgagaaatcagaaggagccggaggcacagcgcatcgcaaccgccctcgaaatttatgttcacggctctctgaatgtcttcaatcacagaacgaatgtggatgtcaacaaccgcttcgtctgctatgacatccgcgaactcggcaaacagcttaaaaagctcggtatgctgattgtgcaggatcaggtgtggaacagagtcaccgtcaaccgcgcccagcacaaggcaacgcgctactacatggacgagttccaccttttgctgaaagaggaacagaccgccgcgtacagcgtggaaatctggaagcgtttcagaaaatggggtggcatcccgaccggaatcacgcagaacgtcaaggatcttcttgcctcccgcgaggtggagaacatttttggtgcgacacgttgacgcacaaacatcacgctatgagggtaatacttcatagacttatggccatgtgatgctaaaagcgtcgggcttatctcggcagggatgagcaacaactgataacccgataggtagaatgaaggagtaacgccctgaaatgcctactctgatacttcgaccggcttcggctgtaatggctggagtctggagctcgataaagtcggcggaagtttgtcgtaacagcgtggcaacacggctgacgaaagtgcagtagaggtactgtatgcagatgacacgccgggagtctataaaatatctatggtgagaatgtctacgacggactgacgaaaaccgcgaatgtacgggtctagaggtttaccgtatagaaatgtacggacacttaaatgtgggtcagtgcggtaaagtaaaaatcgaaaatatgaaattccgtattgtgttacaggcacaatcaagctgacaggactatagcggacacctaaggatatatgtacagatagggttatcggaacgtggaaaggtacagagttgctcataagcaatctgcggacgaatcatataagccgcttaatctgtgctgaaaagcgaagctcgaacctatgacagcccaacgaaaaaggcgggcttgaggaatgggctttagtcggttagaaactattgttgtcattcaatcgtataaggattacgagtaagacaaaaagggacactttcccgcgaaaggagagtgatgccttatgaccagaaaaaagaaacaactgctatgtgaggaaaatctgcgacataacgagtattacggaatgcaagataccttcgataatctatatgctgccagtaagaatggtgaggtgtttacagacctcatgtctatcgtccttcaaagggaaaacattctgctggcatacagaaatatcaagaaaaacacaggaagtaaaacgtgtggaacagataaactcacaatcagggacattggaaagtgctcccctgatgaagtagttgaaaaagtgagatttattgtaaacggaagtgagcatggttatcgtcctaagccagtcaggcgaaaggagataccgaagccatacgacccgagcaagacaagacccttaggcattccatgcatctgggacaggttaatccaacaatgtattaagcaggtaatggagccggtatgtgaagctaagttcagtgagaacagctatggctttagaccgaaccattccgtagaaaacgctattgccagaagttataaactgttacagcaagcaaacctgcactatgtcattgaattcgatattaaaggattttttgacaatgtgaaccatgcaaagctgattcggcagatttgggcaatggggattcacgataaggcgcttatatttgtgcttcggagaatactgacagcacagataaaacttgaggacggaacatttattacgcctgataagggaacaccacagggtggaatcatttctccactccttgcaaacatcgttcttaacgaactcgaccactgggttgaaagccaatggcaatggagtccgatatgcaaaagaaatgtcagacctgaaaacgggtacagacaggcgaaaaagtccaacctcaaagagatgttcattgttcgatatgcggacgactttcggatttactgtagaacgaaagatactgctgaacggacaatgcacgcagttatacagtggttaagagaaaggctgaaactggaaatctcagaaaagaaaacaaggattatcaatgtcagaaatcattactcagacttccttgggttcaagatgaaagttcacaggaaaggcaacaagctggtggtaatttcatacatcgctgataagaattttgaccacaagcgccagaagctgaaaacacaggcaaaacggattgtccatccccgaaaaatctatggagaacagggtgaaatcaggctctataacagtatggtcacaggaatgcagaattattactgcattgccacccatatcaaccatgattgcgcaatactaaatcgtgcagttatgacactgctcacaaataggcttagtacccgtaacgggaatcgattggttaaaaccggacgggaattgactgagtttgaaagaagccgatttggaaaatccaaaatgatgcgatatgttgcaggcacaaatgagccagtatatcctattggctacacgcaacacaagaatcctttattccgtaaaaaaacatggaattactacactccagaggggcgggaaggcattcacaataacctacgaatcaatatggccattctgctctcgcttatgcggaagccaccctatggctatagcgcggaatatgcagataacagaatatcactattctctgctcaatggggaaaatgtgctgttaccggtgaagaattctcaagtacacatgagattcactgtcatcacaaactgccccggtatcttggaggcgatgattcctatgggaatcttattttagtgaaggattctgtacacaagttgattcatgccatcaatgcagatacaatcgcaaaatatttggaactcctacagcttgacaagagccagctcaaaaaggtaaatacgctccgtgagttggcgtctctgccgttaatctaatctctcactaatcaacacaacacagtatttctatgacaggtttgattgtttagacaacgaaatctactaaccgatggaacgccgtgtgcggtgaaagtcgcatgcacggtgtgaagtgggggaaaagcctgagatgatatcaggggcttacctatcactataaaactcggattttgtctaccttctgaatcaggcatccggcgaccggcagattctctcgaaggcgctgaacatctcgcccagccagcagaactacatcaccaactccaacgccggtgaggggctgatcttctacggctcgaccatcgttcccttcaaggacgatttcccgaaggacacccagctctaccgcatcatgaccacccgtttagaagaaaccgtacagaactaaggaggatttttgaatatgaacaacaagatgattaccattccctacgcggacgctatcgaatacggagagaacacctccgcgctgtttaaggctctgtgggagctgaccgatctgatccgactggaaagcaacctcaagaagcatcaccgcgcctacctccatgtgagggaggacatcgacgaaaaggtcaaggaggcgcgtcagattatgaccaaagtagccgtggatatgatcgggttctacttcaatgttgatgtttctgagtgcagcaacagcgatgagaatacccctttcgctgacgcgggtgaagatgaaaccgtttctatccccaagggcgagtatgagctgatgatcgacgatctgctcacgatgtccgaaatcattcagtgcgtcgcagatatgcgcacgcaggatgtgaaggcaatccgcgagttcggcaagttcgtccccgcctttgccgcctttgagaagaaccgcctgagcctctatcgtgaggcggcgaaggaagccgaggaaatcttcgaccgttgggcagacgagattgacgatctcgacgaggacttcatggaagatgaggattacgagccggacgagtattactccgactgatgcccattgaaatgttgtctggttttacagccaacatttcaatggaaacacaaatccaacagaacaggaggtacaccaccatacaacttgacatcattcataccggcgattgccttgaaatcctgaaaacgctgcccgaagacagcgttcattgctgtgtgacgtcccctccgtattacgcgctccgcgattacggcatggatgcccagatcggcagagagacaacgccgaaggaatatatttcgcgcctgacggaagtgtttaccgaagtcaggcgcgttttgcgtccggatggaacgctctggctgaacatctcggacacctacgccgggaaaggcaatcagggcgaatttattgacccgaagaaccccaacggcagaaacggtcaggctgtggctctcaacaacaaggttgagggctgcaagccgaaagacatgatcggcattccgtggatgctggcttttgctctccgcgataccggatggtatctgcgcaacgacatcatctggatgaaggataaccccatgccggagagcgtcaaagaccgctgcgcccgctgctatgagcatattttcctgttctcaaagtccaagaagtatttctttgactacaaggcaatctccgagccgattgcccccgcaacggcagaacgcctcaagcgcggcatgaagggcggcaacaaatacggcaaacccgttcccggtcagcctcagccgcagtccatcaaccgcccgcgcgaacatggcgagatcaaggattctgacatcaatccgctacgcaataagcgcgacgtttggaagatcaacaccgttcccttcaagggcggtcactacgccgcctaccctccgaaactggttgaaacctgtctgcttgccggttgtcccgaaggcggcattgtacttgatcccttcatggggagcggcacaaccggcatggttgcctcacagatggggcgtcatttcgtgggcatcgagctgaaccctgaatacaccgagcttgcctacaagcggattggaggtgaaatctaatgtccaaagaaccggaactcaaagtccgcgacaaggtagtcgtgcggatgacgcgggagggcgcggttgaggaaaacctgacggctggtaccgagcagcgcgtttcgggaaggctggaagatgcagagcttgtgaagccggttgaaaccgccgtgccttccgaagctccttctgcgaaggaacagaaaaaggtgcagatgcgccgtcagcagcgtcagtttcaggcggaacacgccgaggataacgacacacagccgccctcggaaacgtccgtcacagaagagaaaagggcagaaaatccaccccagaatgtatccgaaccgctgccttcgtcagaaacgccgttcaagcctccaactttagagcagcacggcgtttcttctcataccggcacggtgattgccgaaacggttgtcacgcacaagctgcgtaagacctctgcggttgaagccgttgatgcggatgctgttctctcccaagcggcggagactgcttccgcaaagccgatcatcgacgatgccgtctcgaccacgaagcggatgcagaagctcgaaagaaagtccgaaaaggcgcatgagcgtctggacgctgcccgcgagaagctacccacgcacaaggttctcaagaaagagcgtgtcttcgatgaagagaccggcaagggcaaaacccgccttcattttgaggatgagctgaaaaaaccaaagggcaaaggcaagctgcaatttgaagcggataaaaccgtccgcaaggtcggtgacaccctcgcttccggcattcacggcaaaatccatgaggtcgaacaggaaaacacggcggttgaggcggcgcataaaacggagatcgccgctgagactgccgctcggcatttccgtcatcatcgggaaagcagcgtcaacaagccttatgagaaggtctccaagctggaacataaggtggatgctgcggatgcaaagctccaatatgagagaaatcagcaggagcatcctgagatgaagaagcagaacatgaacaagcactatcagaagcagaacatcaagaaggaatatgccgctgcacggaatgccggttctcagactgccgggactgccacaaagaataccggcaagaagctcagtgagaaggcgtccgacaagatcaaggagttctttgagaagaacaagaaggtctttatctggatcggcgtcggaattgcccttctcgttttgctcggtgccggaatcagctcgtgttcgatgctcacctctaccggctcgacggttatcgcttcctcctatctcagcgaggatgacgcgatgcttggcgcggaggcgcagtattgccaaatggagcaagagctgcaacgctatctcgacacctacgaaagcactcacaactatgatgaataccacttcgatctggacgatattgagcatgacccctatgtgctgatctccattctctcggctctccatgagggcgagttcacgctggatgaggtacaaggtacgctccaaatgctgtttgaaaagcagtacatcctcaccgaagaggttatcgtcgaaaccagataccgcacggaaaccgacacatgggcggacgcagacggcaacacgcacacggaaacctatcgcgtcccgtatgactactacatctgcaacgtgaagctcgaaaacttcaatctctcccacgtcccggtctacatcatgtctcaggaacagctttccatgtacgcaacgtatatgtcggtgctgggcaaccgcgaggatctgttcggtgactctccctatgtggacaagtacatcaccaatcctcccgctgactacgatgtcaacccggaatacctgaacgacgagaagtttgcagcgctgattaccgaggcggaaaagtatctcggctatccgtatgtgtggggcggctccaatcccgacacatcctttgactgctccggcttcgtcagctacgttctcacgaacagcggtcttgtgaataccgggcggctgggcgcacaggggctttacaacgtctgtacaccggtttcaaaggcgaatgcacagcccggtgatctcatcttctttgtcgggacgtatgacacccccggtgtgtcccacgtcggcatttacgtcggtgatggggtcatgatccactgcggcgaccccattcagtacacatccatcaactcttcctattggcagcagcatttctacgccttcggaagacccgcctattaaaagaaagattaactattaaaagtcaaccccaaaatgaatggtggaggtcaaacccagatggctgaaaaagggcatagcaaagcagaggtccgttcggaccccggatgtaaacaagagtaagttaggcagttaggcggtacggttgcccagacttctccagagcgaaaatgaggcgcaccagcttcttggctacgtgggagatcgcaacattgtaatgctttccttctgcccgtttcttggcaaggtaggcggcaaaggtggggttccacagacagacatacttggtggcgttgtaaatggcatagcgcaggtatcgagagcctcgtttttccatgtgcggatagcaattcttgagctgtccggattggtaggtcgagggcgagagtccggcataggcaagcagcttgtcggaagatccaaagcgtgaaaaatccccaacctcggcaaggatcatggctcccatgcggtaaccaatacccggaatggtggtgattggagaatttatctcatccataatggattggatggccgcttcaatttcatcgatctcagcgtccaattcccggatgagatggatggtatgtttcagttccaatgactttgccggcatcacagagccgatagaatttctggcagcatcgcggatctccacagccatatcccgtccgtagcggcctctggaagcgtcggtcaaaagggatttcagcctcgtaagatgtgcaccggcaatctgcttggcaccaggaaactcagccagcaaggcataaacagaagccatatgtaaggtcggcaccagcttttccagttcagggaacaagatgcagaccagcctggaaaaagagcttttcagcttggctcgttctttcaccttgtcgaaacgatatcttgtgagtgactttagctcctcgttgtggtatgctgtatccgtgtagggcttgaggcccacatcggacaaaagcatagctgcaatcgttcgtgcatccacacggtcggtctttgtctttctgagactgaggcttttccggtacagattggtgcgcagagggttcaggacataggtggccaggccgttgtcaagaagaaacccaaggatgttgtagctgtaatgcccggtcgcctcaagtcctacttttatgttgtcctggggcgtggtgcagttctggattttttccagcaggctgttgaagccatccatcgtattggagatggtgaacacatccgccaggacttcaccttccgagttgacaatgaagcagtcgtgcttgtccttcgagacatcaattccaacagaaaccatagcaaaacctccaacggtaaatttgtgatgctgcatccacagagcgccttacttttgtagccttgttccacataaaccctctggcggtatttaactgattaacaaaagtgtaaggggctgtggttggaacctttcttgaaccatcttgtggtaggagttgatcaccaatccacagcatcccttacagtgtagcacagcccttggagaggggctctaataactactactctataatacaaggagttttgcatgaatcccaagtatcagaaagtcctctccgacattgagaaggctgaaaagaagaagtccgaaatcgaagggcagctcaaggagctgtacgacaagaagacggagctggaaaaccttgaaattatcaataccgtgcgctctatggtgatggacaaggatcagattatggcgttcctgtcttccatgaaaggcggcaccaagcccgctgaaaatacggaggtaatcgacaatgcgtaagaagtttcgttttctgaccatccttgcggtctgcgtcatggttctgtcctgcttctctgtcacggcgtttgcctacgccgatgataccgagcagaaccttcccgttacggaggcaactcagcccgaacagcagcccgcagtcactcccacgccggaaaagccgaagggtgagccgattgacgatgagggcaacgcctacacccgcgacttgctctatgacaaggcaaccaacaagcagttcatcactgtccagacgaagaacggcaacacctttttcattgtcatcgactacgatgcacccatcaatgaggacgaggaacagtataagacatacttcctcaacatggtcgatgagagcgatctgcttgcgctgctggatgatgatactgcggctgcgctgaccacctgtaactgcaaggaaaaatgcgctgccggtcaggtcaacaccgactgtccggtctgcaagaccaacatgagcgaatgcaccggcacagcccccgttacacctgagccggataaggatgcggaaaccgatgtccccgcccctaaacccgaaaagaaatccaacatcggcatgatcctcgtcatcttcgttcttgccggtgctgcgggtgcagcttattactacatcaagttcgtcaagggcagaaagcccaaggatgaggatatggacttctttgacgatgaaggctacgaggaagagccgtacatcaacgaggatgatgagccgcagatcgcggaggatgctgaaacggatggtgatgaagattgatcttagtcattgctgaaaagcccagcgttgcccagtccatcgcaaaggtgctgggcgcgacgtcccgcaaggacggctacatggagggcggcaattacatcgtttcatggtgcttcggtcatctggtggagctggcagatgccagctcctacgatgagcggtatgccaagtggcggtatgacgatctgcccattgttccagaaagctggatgtttgaggtcacgaaggacaaagcccagcagttcaaggtgctgtcctctctcatgaaggacaagcgcgtcaccgagctggtctgcgcaaccgatgcagggcgcgagggtgagctgatcttccggctggtttacaacaaagccggatgcaccaagcccttcaagcgtctgtggatcagctcgttggaggactccgccatccgcgaaggcttcaaccatctccgggacggcaaggaatatgaccgcctctatgaagcggcactcagccgctcgaaggcagactggattgtcggtatcaacggcacccgccttttcaccacgctctatcacaagaagctggtggtcgggcgcgttcagacgccgacccttgcaatgctggtggagcgcgacgggaaaatctccacgttccagaaggagaagtatttcaacgttcacgtcggcaagggcgatctgaccgccgatctggaaaaggtcaaaaccgaagaggaagcaaaaagaattgcggcggcttgcgagaaaaagcaagccgtcgtttcttctctcaagcgggagacgaaaaccgtcaatcctccgaagctctatgatctgaccaccttgcagcgcgaggcgaaccgctactacggcttcaccgcccagcagacgctcgatctcgtacaaacactctacgaaaagaagctcctgacctatccgcgcacggacagccagtttattacggatgatatggaggacaccgcccgtcaggtcatttctattgtctgccgccagcttccgcttttctccggcgtttcggtcactccggacatttcccgcgtaaccgacaacagcaaggtcacagatcaccatgccattctcccgaccgtccagcttgaaaagcaggatgtttcggtgcttcctcagtcggagcagaaaatcctcaatcttgtcgggatgcgccttctgtgtgcgaccggcgagaagcacacctacgcagaaacgcaaatcacgctctcctgcgagagctatacgttcaaaaccaagggtaagaccgtcattcaaaacggctggaaagccatcgaagagctgttcaagtcctccctcaagacgaaggaaaaggacgatcccatgaagtccctgcccgaagtccatgagggcgatgttctggatggtgtgtccgccagcgtcaccgaacacttcacgacacctccgaagcagtacacggaagataccctcctgtctgcgatggagactgccggaaacgatcagtttgacgatgacaccgagaagaaaggtcttggaacacccgcgacccgtgccggtatcattgaaaaactggtaaagtccggctttgcagagcgcaaaggcaaatccctcattcccacgaaggacggctgcaacctcgtctgcgtcctgccggaacaaatcacttctcccgcaatgacggcggaatgggaaaacacgctcatggagattgagcgcggcaatgcggatgcagacgcatttctcagcggcattgtccggatgaccggggatctcgtgaaagcctatcccttcctctccgacgccgaagcccagcgtttcggcacgggcaaggaggaaatcggcaaatgcccccgctgcggctctccggtctacgtcggcaagggcaacttctactgctcgaacaaggcttgctccttctgcctgtgggaagacaacaagttcttttccggcaagaaaaagaagctgaccaagaggattgcaaaggagctgctggacaagggctggtgccgcgtgaccgggctttacacgccgaagaagcctcagctctacgatgcggtgatccggctggatgacagcggcggcaaatacgtcagcttcaagatggagttcgaccgatgacccgcccaaagtatgttgcttcatgcagcggaggcaaagacagcgtagcgacgctcctgctggctgcacagcacaatgagccgcttgacgaggcggttttcagtgaggtcatgtttgatcagaacacaagcggtgaagtcccggaacaccgggacttcatctatgaccggctcaagcccttctgtgaaaaggagctgggcatcaagttcaccattctccatgcagacaagacctacgatgatgtgttccatcatgtcatcacccgcggatcgcacaagggcgaggttcgcggcttcgcatgggctggtatgtgtgcagtcaatcgagactgcaaaatcccgcccgtccgcaagtacaatgccgcactctcgccggacaccgtgagctatgtcggcatcgcggaggatgagccaaaacgccttgctcgtctggatggagtaacgaaggtcagtctgcttgccaaatacggcatgaccgaggcagacgcctacaagctctgtcaggaacacgggctgctttccccaatctacgctcactgccgaagaaacggctgctggttctgtcccaacgcaagcgacgaagagctgctgcacatggtcacaaagcacccggatatgtttgaccggctgattgaatgggagaaggaggataacatctttcatcgtcggctgacacgcagagaaaccccgtctgaggtaaaggctcgtttactgagcaaatcccagacggggttttcttcgcccaaaagcaaataagaaatggaggtttgagatgactgaaaacaaaaatgcacagcaagtccgcgaaatcacggacaagctggaacagggcatcaaggagctgtttgaatccgagcggttcaaggaatatctccgcacgatgtccaagttctacaactattccttcaacaacacgctgctcattgcgatgcagaagccggaggcaacctatgttgccggttatacctcgtggcagcgtaactttgaccgtcaggttatgaagggcgaaaagggtatcaagattcttgcacccgcaccgtacaaagcacaggaagagcgtgagaagattgatcctttgacgcagaaaccggtgatcggcgcagatggaaaggctgtcacggagacggtcgaggttctgcgtcctgccttcaaggtggtaagcgtctttgatgtttcccagacggacggcaaggagcttccggacatcatcgtcgatgaactgaaaggcaccgtcgaaaactacgaggcgttcttcgacgcgctcaggcaggaatctcccgtccctatttcctttgaggatattccgggcggcgcgaagggattcttctctccggttgaaagccgcattgccattcaggaaagcatgagcgaaatccagacggtcaaaaccgccattcacgagatcgcccacgcaaagctccacgccgtcaagccggatgagaaagccgcgccagaagataagaaggatcggcacaccaaggaagttgaagcggaaagcgttgcctacaccgtctgccaacggtacggcattgaaacctcggactactccttcggttacatcgccggttggtcatccggcaaggaaaccaaggaactgaaaagctctctggacaccatccgcaagacggcggctgagatgatcgagggcattgacgccaagctcaaggtgctgctggcagagaaagcacagtccgtagagaaggaagtcgaagctcccgtaaaggaaaccgttccggaggaaaagacggaagtacccatttaccgcgagacggcgaattacgcctatgaagccggtgagctggagtcatatcgtgcttctctcgccgcaaacgtggaatgccgcaaagcgattgaagcggcgatcagctccaactacggagacaaccggctgaatgcggatgctgccgtgaagagcgtccttgagcaattctctccggagcgtgtccgatatgtcctcgcaaacaccattcagcagaaagactttgacgggcgtattccccaacccctcaaggagtgggcgaagagcgttgaggtctgtccagagaatgcctcccgcttccttgtggataaacccaatcccggactgacggcacttttcgtggatgcgttccgacagcagaccgaagctcaaaaggaagtcatgcctgagaaagcagcggaaagagacccggaagttgttgcatgggagaacgatgagattacctctattcaggtaaaaaccgtggaggtcaagtctccctttgcctccatgccggaggaagcggcaaaagcaccgaaagcgcaccgcctgactgccgaagagaaggaaatcaaagccgccgtcatggacacgctcaaggggcagattgcctataacaacgacggaatgcgggcgtcctatcgcgcctctaaccattccttcaatctgctggcgcggaacggcgtcaggatcgaaggcaacacggtcacgcagaacggtgagccgctgttcaaaatccatcgccgtcatgcggcgcggaaaacacagggctgttaccgtgagctggtgccgacgctggaatatgtcaagcaggagcagaagcaggaaaagccctccatccgcgatcagctcaaagctgccgcaaaaacacagccggagaagaaatccccggtcaaatccaaaacacacgacatggagttgtgagaaaggagacgcatgaagaaatacacagacgttgacattatcgcggagcttcagaagctcgtggacagtcatgtagacagctacaaggaagacttcgacatcgacaagcgcatcatccgccgcgctgccgaaagccagaatcccgaagacaagacgctgatgtggttctgccgtccgcatgggacgcactgcctcaatgaaaatcaggtcttcattcagggaacgcgggatcacaacaccttccgattttacgcagaacagacctacgacgagtgtattgcccgtgtcatcgttccgaaagccgtcaagcgcggcaaggtgttcggggacgtctttgagatcaattaccgggaacaggcggcaaacgtagcacagaactcggctgtgccggatcatgatcggctgacgttcgcggatggctttgtgctggatgcgccctgccgcagcagcttcgatgcagcaatggctctggtcggtgagcatggcggcgtcaaaacccaccagacgctcccgaaggacgcggatgctctggcggaagtgctgtccaaacagaaaagccgccgtgacagactgccggatgcagaaaggacagaggcgctttcgcctctgcccgttgcagaacttcggaagtacgaagcggtcaaaaaggcgcatccggacgcgctggtttgctttgcccagaacggctattttgagctgtacggcaaggacgcggaaaaagctgcacccttgctcggcacaaagctccttgaaaagaaggtacgcggcaagccctccatgccggtaactggcttccgtgaagctgcatgggtagccggttctcacaagctctggaagtccggcgtgaatgtctttctcagcaaggacggtgagaccttcaaggaactcaaagccgcagattacattcctgtcggcgcgacgctgaatgtggacggcattaagtgcagaattgacgcggttgattttgcggctgatgaagtccaactgaccaacattgaggacaagaaccgccccatccgcttttctgagagcatccagtatgtccgcccgtatgtggaagatgccggtattaccgtctatgacaccgttccgaagaagcccgctgcccgtgaatccatccgcgacaagctgaaatccgcgcagaaagcccagccgtcccacacaccgaagccgcagaaaaacaaaggaaaggatatggaactctgatatgaagaattttaccgtggaagaaatcaacctgatgtgctgcttcaacacgtccagccggaagcggctgatcgacgatatgaagagcgtcaccctgaacgacatggacggagagatcgcagagctgatgtataagaccatccagaagctcgaagccatgagcgacgcggagtttgaggaactgtatatcatgccggacggcatggtggatgactgaaaggagaatgcctatgcccgtattagacggtgattttgaagccttcgtcacaaaccttggcaagtacaacgagggtatgctggtcggtgagtgggtgaagctccccaccaccgaagaagagatgcagaaggtctttgagcgcatcggaatcggcaagcaggatgagttcggtcagccctacgaagagtggtttatcaccgactacgaatgcccgatctacggcgttcagaagatgcttggcgagtacgaaagccttgataagctcaactaccttgccgctttgattgacgagctttccctgagcgatcaggaaaagctcgttgccattatggaagccggttgcgatgaggtcagcgacatcgacgatctcatcaacctgacgttcaatctggactgctacgacatcatgcccggtatcaacgacgaatccgatctcggctattattacgcacacgaagccggtatttactctgaaaaggatctcggtcctctggcaaattacatcgactatgaacgctatgggcgcgacattgcgatggatgagcagggacgtttcaccgatgagggctatgtccgcgttgcaagcgagaggtgggacaggcagtttgacggggagcttgatgatattcccgacgaataccggataaccggctcaggagaagccgccgagcgtgacagcactattgcagttctcgttgttgagccgggaaaggagccttatgtgaaggagattgactccggtctggagtccttgcagcatgaggtcggcggctgcatcgaggcgatttatccctacgaagaccctgttgccttagtctgtaatgaggaaggcaagctggaaggtctgccactgaaccgcgctctgcgtgatgaggacggtgacatctacgacgttgttgccggaacattcatggtagtcggcttgacggatgacagcttcggctctctgaccgtagagcagatgcagaagttctctgaccacttcaaagtgccggagcagtttgtcaagctgggcgataagattgtagcgattcccatgatctcgaaggaacagcagaagcaggaagtcgcccagcagaaggactttgagatgaatgccgatacctccggtctggcagttgccggtcacatcgggacgtggcacaccattgaccagcacgaagtcggcggtcacagcttttaccttatggagcatgactcctacggcgatgaggctgcctgcatcattgtcgatgagcgcggcaagctcgtccttgatgatgtctacaatggctttgacgatgacacgctccgccttctcgaccttgaggtcaaggaagtgtcggaaatgcccgatcccacgctctccgttcaggatatgaaggactatggctatgcatgggctggcgttcttcccgccggtcaggaggcggctgagaaggctttggagaagggctgcgaggtttaccgtctctattccgataacaccgagggcttgtgcgtagatgcaaaagagattgccgatcatgcggcaaagggcggaatgctcggtatcagcaaggaaagctggatggcggctcttgagaaggaaaactatctcaaggcagcggagatgtcggtggaggatgactacggcatgattgatgggatcatcaacaacggtccgaaggaagacaagacccttgatgccaaagctcccgaaaggggcgaaaagtcctccatcatggacaggctcaagtctgcaaaggctgaaaagcagaaggaatgctgccctcccaaaaagcacaaaggagagattgaactgtgagcagaagtcagaaatggcggcaggagtggtcattcttcatcggggacagcggacgccggaagtataaccgcttctgcgtccgctgcatccatgattgcaagcagagctttcgtgtggatctcctcgcctgtccgcacttctcccgcaaggcatcgcagtgtagacagttagggggcgaaaaagcctgtgattgcaagcctcagagcggcgcaaactgaccaacctaagtgattgtattccctgcgcagtttcttctttagcgcggaaataagtgtcgatttcggcacttgtttgaatgcccggaaaacgaaccaagagcctctgtcgatgcccggtttgggtatcggcagaggctctttttttatgacatattcaaaatagcggacagcagctcttgaacctgttgccggtattccggctttatatccgaaatacgtctggcaagcgcaagggcttccgcttctggctcatcggtcccaaagataattcggtccgcactgacgcccagcaaacggcaaagacgctgcaaggcttcaagagaaataccggaagcaccacgctcaatagcactcaggtgattcggcgtcatgccaagcatttctgagagcgtgtcctgcgtatagcccgcctgttctcttgccacttgaatattgccgccgatttcaatattgatgtccttcttctctcgcatagcctcaccgcctttgcatttagtgtacctaacggcggtgtcattatccacggtacgccgtcgttgattttactaacgacaatgcgttgactgtccgtgatgagggtgatagaatggagttacctaccaaaagagtgaaagaaggggtgtcatgtcgcgcattattgagtttagaaagtctgctcaaaaagctgcaaagcaatccgttcaaggcaagacttgtgcgtttaccggtcatagaccgcagagtcttccattcggctttgatgaatccgataagcgttgtacttctttgaagtctgttatgcgggatcagattgtagcactcatcgagaacgagggcgtcacgcattttattaccggcatggctctcggcgttgatatgtatgctgcggaaattgtacttgatttgaaatcaaaataccctcacattactctggaaagcgcaatcccttgtgagacacaagcgatcaaatggtctgtggcttcacgggaacggtattataatatcgcggcaaagtgtgacaaggagaccatgctgcaacgtgagtacacgccggactgcatggacaagagaaatcggtacatggtcgatcacgccgattatattctcgcagtatggaatggatgccccagcggaaccggaaataccgtgagatatgcccacaaaatgagcaagtccatcatcgtcatcaatccggcttcccttgatgtcacgcgggaataaggcaaaaatcccccttctaaatcaagcgtcgtgaaaaccgtgaagtatttcccgatagtgaatacacattgcactgctcagtgattattggaaacgagtacggcgtatgctgcccagtgaacatctccacggaacacatcgaattttcgcggcttcgtaaaacggaaagtgtcaccttatgaacggtcccttgctgagagaaaaataaatcgctggaaacgggaacgcccccggcactgtgcgtctggcacagtgtcgggggcgttttttcgtgtcttagttatgagccagttcatttaggagcagctttcgatagtccacatccaagacgcagcgatgaaagtccatcagacggtgttcgtcgaacagcttttcacagagcttggtcagaggatgattcatcagctttgcagaaatgccagtctcgttgaaaaaccttgcccatgtgaagacctcttctaaatcctcctgcccaagcgtggcgggaatgatggcgttgcagaggcggacaatggggctgtccgcaaatcgctctgccacttcctccggtgtgcattcatagcggtcacagtcaaaggaaagtgcatcctcaattttaagataattttcggtttcatcccgcgtcaaggttatggtgtagtctcccataccggacggcacatcaatattctccatgacatcaagctcgaaacgggagccgccgatgatcgcttcaaaggagaaggactgacagattactgctgggtttttgtctatcttgtcctcattcagaaaggacagcggattatactccgtcagttcccagccgattttacctctctctgtttgctcggcaatctgctggatcagatgttgttcttcttcgtgcagattttcattgtacaacatgatacacctccgttttctgattgtcgtttttggggggctgttctatgtttccgaagagactgccgtttctatcatcattccttggctgagggcagaccttcgtaaaacttcctaagttcgtccaaactgcttgtccgatttttgataggcagggagtcccatgtaatgtcatgatagcgttccggcggctcgtcccgcagtcttcggtcgataatgcagacaatgccggtgtctgtgaaattgcggatcaatcgcccgataccttgcttgagcttgataatcatttcgggaacgcggacatccatcagggcatcctttgcgacggaacacttatactcgataattggatcggggacaggaaacggaagccggaaaatgatgacattggaaaggctttttccttcaatgctgattccttcccaatatgcacccgtccccagaagtacggagttcgtatcttccttaaactcaagcagcaccttgtcctgcgacgatcccggctgctgcatcaggattttgtacggaagatttttctcactgagaatggagtagacctcttccatgtcggtctttgccgtaaacagcacgagtgcctttccattggaaatgctcaggatctcaagcagtcgctccacgcccttttcaatgaaggcttcatgttctctggtcgggtgcgggagatcgtcgcaatagtagatcatggcgtgttcatcgtatggatatggggaaggctttggctcggataagcagccacgatcaccagcgggaaagccggtattgctgataaagtaagaatactgttcttccagagacccgttcgtggcgttcgtcagcgtggcagaggtcaagatggttctttcatcaccattgaagtataggcggctcacaatttcttttgtgtttttagggcaatagacgagttccgtgttgctgccgtgctgctcaatccagatcagcatatcatctatccggtcaagaagctctgaaagggactcgctgacggcatccagatcatcagaggcagcaaaggaacggttgtttctgaaatccatgctggaataaatctgaatgctggacgaaaggttgtgtatggcggcgttcatctcggtaagcagttcaatcgcactgccattgttgtcgaagaaaaagcggtcagcgtagcgcatatcctgctctgcctcgttgatctgcttttggacttgtgctttcaggcagttatagaaggcgatgattgcgctctctgcctctcgcttttcacctgacacactgctctggtcaaaggatcgcagctcatagaatgcgctcttaatcattccaaagagcataccttgcccgaaacgctccgttgtggcactccgcaccttatcatccaagttgtgtgcttcatccacgacaagcagatcagcggcggcgttaatcagcccttcctgaccgcgccggagtttcatcagatgctgggttagaaaatcctgattgcacagtaccactccatccgtaaactttaatgctgcgcggactttgtaatacttgcacttcttttcacagaagccacaattcttcatgctgaaccgctgcacatttaccttgtcccagatgccttgcggcaaaacctccgggaaatccttgcgttcctcatacccctgctggattccttctttgagcgcgtccggtgggtcagccttcgggtcacacatatactcatctgcgcgtttgttgcagagataatgggtctgtccttttgcgaggatgacatctctgttcagcccaagaaggggcattaccgcgtggacatcgcgccagagctgttcttgaagcgcaatggtcgaggttgcgatgataaccggtttgttcatgcgtttgctgtacagcagcaccggcacaagatagccaaaggactttccaatgcccacgccagcttcaatcgcaaaatgctgatcgtttatgagggcgtccacaatctcaaaggacatatcctgctgtccctcacgcatttccaaaccatgctgcggggcttcatcccaaaagaaggtgctgacttgctcactcatggagtacagctctgcttttctgcgctttttccgttcctccgatgtattgaatccaaaatagaatctgttgtccatccacattcctcccggaatagaaacctatgctatccgcgtttcagttcaatgctgacgtttccgttctcgtcgatggtcagcgtcatgtgtctgatgtgcttctcatagaactgccgccgctctgcgggagacatttcgatcctcgtgtttcgcagagcagcgtcaaacatatcgttgacgttcaggtgaacggagttgtcaatccagcggtacatctccttgaatagtgcgtttttcttgatgtcctcgctgttgccggagtagaagtcatccagatagcagtagaatatcccggattctgcaagtgccgccttcatatccggtccgcatttttcccgctcaatcatgacaaggaatctggcgtccggcaaggaagagataagcccccagtagtcggaatcgcttgagacgatgacgaaggaatccacttgcttctggtagtgttcctgacaggctcttgcggtgagcttgatgtctaccagtgatttgttctgcttgatccgctcaatcatgatatgctcaacggggatgcgggtgtagttttcaagaatccgccatgccgtagcggtatgtacgtcatcaaagagaatgatcgccgtaattttctgcatgacctcataatcaagatttttgagcgtggcgcacagcttgtacgggtcggagttttcgcagtccactaccaatacggtcttctcgctgtcatcaatgaagtcgtagatattgttttttacaaaagcaccggcatccgagaccttactgtattctgtaaatgcgtcattgtgccattgatagagcagcgttgcaaacttcttgtcattatagaggacattgccctcgtccatcggtacccagttgatgtacatttgataggggtagtaggagagacttgcgtaatagatgtccgcagcatctttcgttccgtcctctgtcaagccgtttggcataatgaacagctcttttatgtacgcccagttaatccagattggaaagaggcttttgcagttgttaatgcggtctgaaatcagccggttgatctcgataatgtggtggcagagctttgtactcgactttttgataaagctgattccgtcatttgaaagctgctgcatactggacatcggaaggatctcaggcatcgaaagaagcccacggtattccatccgcatgatgtcatttattttccggtaattgcgctcaatggcggtgcggatgatacatagattacgaatgatacgggcatttttatcctgttcaagccggttgtatatctctatcttcggcggctcgtgttcattttggaaaatacgaagcgggacgccaatcaggtaagcgacctttgacacaagctcataggtgctgtctttgtaggcattctgctctccggcatattcgacgccattcaacatgactgaattgcccatgatctactcctttcgatggaacgcgggttattgagcgtactttttgaagttttcagcttgttccagaacctccttgtagacatcatcaatagttacggggggatagtcaaattcatccagcagcagtatgaggtcaacttgcagatttgccttaatgtcatcacgggtagaccagtcggtgtatttagctttgtcatcgacaatgatcttaatccgctttgacaattcaatcatcttatcgtccgggtactcgaactcgtacttcctggcaaccgctttgaggatgtcatagaaggctttttcttcatagtcaatccccatacccttgaaggagtctttttcctttttgagttcttcaaggagcttcgcaagttgttctgctacatcgtcaagaacttcgttagcgaaagcctcatcacgacggcgattattgtactcatcaacaacccgcttgagacggtcagagaactccatgcccatgatacggttgacctttttatactcatcaatcgcctgagagagaagccgctgcaataccttgattttagtgttcggtaattggattgcattgatcttatccagatactcgtcactgaaaatatcgacagagatgtgctttcccgtctcaaacagttcctctataccatcagattgaattgcaccttcaagaagttcacggacacgggcattcatttgtgaaatgtcaggggcatcaccctttgtgagtttgaaaagaatagagcgcacagcacagtagaagtgcagatagtccttttctttatcagagatagcctcacttgaactgcataggttgaacgcttgtttcatgcgtttgactgccgccataaagcgagtttccaaatcttccgtgagctgtacatactcaacagcccgattgaggcaagcaagctgctctttcggtgagccgttgaagtaatccgtgctattgaagttgtggaacatctgagccaagacatcgagctggtctttaacaatcgtgatagactgctcgacgccttcaaactcatcgctctcaaagttggtgtatttcttgagggcgagattcatgtttttcttaatgccgatgtagtccacgatcaagcccttgtccttgccggtatagacgcggttgacgcgggaaatcgtctggataaggctgtgctgctggatgggcttgtcgatgtagatcgtgtcgagtgccggtacgtcgaagccggtaagccacatatcaacaacgatggcaattttgaagtttgatttaacgttcttaaactgacggtcaaactccttgcgatcatctttcgttcccagcatttcataaagctcaggctcatcatctttatttcgcgtcatgatgagcttgatcttttcgatgggtttgagttcctttttctctttttccgtcagttgaaccccgtcagggcaaacctttttctctgcccattccggtctcattccaactataatctgataaaaagcgtatgcaatcttgcgattagagcagacaaacattgcttttcctgcaacggtagctccttcggcaacgcgggtctcatagtggttaatgaagtcctccgcaactgcgtgaagtcggtcaggatcaccgatgatcgcatcaatatgagcaaccgccttctggctttcctcaatctgatgctcatttgcgccttcaacagcacagcggtcataataatcttcaatttcccgaacctttgcctgatcaagcgtgacccgtgcagcgcgtccgtcgtagacaaggttgactgtgataccgtctttgaccgcctctgtcattgtgtaggcatcgacaaccggaccgaagacttcaatcgtgccatctacgggcgtgccggtgaaaccgacataggtagcattggggagagaatcgtgtaggtactttgcgaatccatagcttcgctctacaccttcggcagtgaccttgattttctggtcgaggtttatctgactacggtgtgcttcatcggatatgcagatcacattcgttctatccgtcagaagctccaagtcctcggtgaacttttggatggtggtcatgtacaccccaccgcttgtcctgccttgaagttcctgacgcagcttttcgcgggaatcaatgctcacaacggtttcgtcaccaatgtacttcttggatgctacaaactgctttgagagctggtcatccaaatccgttcggtcggtaataatcaggattgtagggctatggaagaaggtactcttcataagcattcttgtgaggaagagcatagtatagctttttccgcagcctgtcgcgccgaagtatgtgccgcccttgccgtccccctccggtctgagatgtgccttgatattctcaaacagcttgaccgcagcaaaatactgaggatagcggcagacgattttgaggtctttgtccgagctatcagggaaatagacaaaatccttgatgactgccaaaagccgttctttgcggaacagtccgctcaccatagttacaagggaattgatgccgtccaattccttatcgtcagcttcaatttttctccacgcatagaagaagtcatacggggagaagaaggaaccgtatttattatttgcaccatcgcttatgacgatgaaggcgttatacttgaagagttcaggaatatcacggcgataacgcacggtgagctgagtataggcgtccatgatcgttgtattttctttgactgcgctcttaaactcaagaacaacaacaggaatgccattgatgaatacaatcccgtccggtatgcgtagttggttgttgatgccttcaatttcaaattggttgacgatcttgaacacgtttttctctggctcatcaaagtcaatcaactcaatgtaaaggtctttctttgtgtgatcttcgcggttgaagatgaagccgtcacaaaccattttgcaaactgctttgtttgcttcgtagatcgtgccggaaatagacctcagacgaaggataatgctatcaacttcgcttggggtaagtccctctgaggcatacctgttcaggaggtacttccgcagatcgtcgataagcagaacctcagagcgttcacggtggatctgctcaccattcaaatagatataaccttcatcctgaaacaactccatgatggacatttcaagagaatgctcattaaagttcgccattatcatttccccctaactgcctctgcatttctacttcaaaggctttttcactttgctggaagtcgtactcctgatacttcaaacccagacgtgccagcatgagtgtaccttcccagtcatcaatgtttgagtattgcgttgcacggtttacgtctgtgagaacaccgaggatcagccctgtacaatcgagtgcaaagtctatcatttcctgtatgtccggatataaaataggatgacgatccgttaggttctcgttgctcaatatacgctgtttatcgttgtgggcatagagcttattcctctgcattcggatgtcctctcttttttactcagcgcacagaaccgcttttggtacagggctaaaaactcaggaaaagtcaaatccacccgaaccggagcattctctgcatccggaatgttaaatatcgcaaagagtgtcctgtcagattcaacctgagccttgaaaaatcgctcttcttgtggcttgagctgatgctggtacgggatttgataggaaaacgctgttccatcatgctctacggtcattgtttctctgtattcaggaaataggtcttgattttccgcgcattttgcaaggagggttccaatggacacgacgccatttgagctatcatacagtttggcgatctccataaaacaggctttcatcaaagctccgtggatcgtttgatagaacgctggtgacatcttcatttcttccgcatattcgcgctggtttttgcgatactgctgcaatatgaggtaataggcatttgcgtcaaaagctccatgatgaagttcctcggcaattttgatcagcgtttccttgtccattttcattcctcccttcgtaggtaaatgataatttagaagcggctgcattatccatctacaaatgcttctttgttgactatattccctttgatggctcacagccatcatcttggaaggaggtaacggttgatgatatagcctctgatgtgatttgcggaaagacacctcctactgccgatccgcaaaactatggtgggacaatcccgtttattacaattccggatatgcacggaagtgtctatacaacatcaaccgcccgctttctttcagagaaaggagcatcaacacagccggggaaaatgcttccagcaaacagcgtttgcgtaagttgcattgcatccgtaggcttggtttgtcttactgctgaaccaagtcagaccaaccaacagattaactcaattatatgcaaagaccaaattagcccgttctatgtatatacgaagatgacaacgcttaatgagtatttgaagcaactcggagctggcggaagtacaacattgaacatcaacaaaacactcttcggtcagataccgatcctacttcctgacgaggcatcaatgaaagagtaccacaataaagttgagccactgttttcttcgatcagagaaaaccaatatgaaatacaacatttggagtctctgaaacgtctactcctgtcccaaatctcaagccgctaaattatcatttatccgccgctttagatcgatccgctccgtaatggtctgatacgccttcacaatgctgcgctgcttatcaatagagggaacaggcagttccactttgcaaagttcatcccagtcaaagatttctctaacacttccgtgagacatatatctggcgtagcggtcaaactctggtctgctaaaccaaagcataaggtattctggatcaagcgcattcttatgcacaacctcaaacacggtatatgaacttgaaatgatgcaatccttatctcggagaagagcaatcgaaatcttttcgccattccgagatgtaacaggaccatacgcaaattgcccagtacgaacaatcttatagctcgacaaatccgttccgacaatatttgcaatggagggaataaactgcttgctgatgctgacaccaagcaaatagtcaactttcaaatccctatttcgttcatcaactggctgaatgaagtctccaagcagcctatatccttctctcatcgtgacacctcaccctatgtattttctgtgtgccagcttgacattttgctgtttgaccatagcatagtgcatggtcgtgtcgatcttctgatgccctaagagctgctggacttgctctatgggcattcctttatctatggctgatgttgccaatgttcttcggaacttatgtggatggacacgaggcagattcagcctttttcccagttctcgaagccgtctttctacgccgccaatctgcaaacgatcatgcggcgcggtcagcgagacaaacaacgctgaacaggtgtctgtgcggctttccagatagttttggagatggatttttgtcctggcatcgaaataaacgatccgttccttacttccttttccgaaaacaacgcattcccgttcattgaagttgatgtcatcgcggttaagggcaaccatctcaccaacacgcattccagaggacgcaagaaggtctatcatcgcaagatcgcggacattgcagcagttgtcccgcatgatttccaatgcctcgtcggtataggtttccttgatcacttttgccgtttttaccttgtggatccggcgtaccgggctttttacgatgtaatcctcatcttcaagccacgaaaagtagctggataggatgcggcggatgttatctatcgtgaccttgcttgacttccggctcatctgatacactgttaggtacttccgcaagtcctcagttacaatctcttgaggctctttttcaatgccggacaacattgacacaatggtctgacggtaatagctcaaggttttttctgagcagccttcaatgcgttttgcgttgataaaacagacaaccgtatcgacctttgcgctttctaccatgcccgcgctgtgacttagctctacgccactcagtaccccctcaaggacgccttggagctgctttaactgtgcgttgttcagatacggaagcatctgacgctgcacttcttgaatcagttgttctttcattgtcgtgtctcctttgattattctcagagaacgacttttcagtggcagttcttagggtaaaactctcgccactggtgagagtaatggacggtaaatgataatttagcggcttagttccgcaagaaaaatgcttccaagctctttcagcttatcaatctccttattgttgattgatatttgtttctctataaaaaggaactgacagtctaaacttgcaagaacggcatcagattccggtatttcaaaaactattttctgcaagtctttgattggtaactgtggctgggcagagccagacttaaagcgctcaatagcagccttcatataggagcttttaagcaaggcataaatgaagtgtggagagagccgttttgttttagggcgaatgataagcataccggagttgattctaacattttcaaatccgatatgtttatcgtacaaagccacattaccaagtgttccacgagaggtaagaacaatgtcgttaagcgatagatgccctttgttcattgacttgtctttctcctcagtgacgaacatacaggcgtcaaagttaaaacctgtagatgtaacatttgaagcatttaagaacaagcagtagcccgcggatgtaaattcatcgaacgtaggatagttttttcctctatctccgtcaatgaaatcaacaagttcgccaagagttgtgggcatagtttgatttttaccgatggtctcaaccaaaattgcttgttcggtattagctaaattatcattttccgctctcttcaaagcaatgcggtcggtaattgcacggtaggactcgacgatctcacattgtctcgcataggagggaacagggagctttatacggcaaagatcgtcccatgtaattccgcctcgaacactgccgtccgtcatgaaccagcactcacggtcaaactccggtctacgaaaccacatcatcaaatactcttcatttaagacatcgcggtcaataatctcaaacatgaaatacgccggagaaactattgcgggactgtctttctcatagagcgcaatcggaagacgttcatcgcgcccaacgtgcattgggttacaggcaaacaatcccttgctgattagcttataccggctcaaatctgtgccaattacatttgcgacggaaggcataaactctttgtcgatgcttatgccaagaacagtgctggtgacttcctcggagttccgataatcaacaagctgaatatgtttaccaaggggttcataattcgatttcatagcccagctccttaaacacggtcaacaggtctgcctttgacttttcttctgcaatgagcagatcacgcagttcactttgcaacgtcttcattttcgtatcaaagtcgatgttctcatcgcggtttacaaactcaatgtaacggctcggaacaagggtaaagcccttttcagcaacctcatcgaaggatgcgctgtaacaaaattcaggcacattctgataagtttcttcatagccttcctgctgccatgcgtgatagacgcccgtgacttttgcacggtcttcttctgtcagttcaatatacttcttttcataagggcttcccatttgccgcaagtccatgaaaaggatctcgcgctcacggttacggaagcgttttacttcaccgttttcttcaaccacacgagcctttttattcttgttcagaatccaaagcgtaacgctgatgtccgtggtgtagaagaggtttcggggaaggatgatgattgcttcgacgagattgttctcgatgagctgacggcggatttttaactctgtaccatcgtcagatagtgcgccgtttgcaagcaggaaaccggcaacaccgttctgagagagctttgaaacaatgttcagaatccagccatagtttgcgttactcgtgggcggaacttcatagccgttccagcgcggatcatcaatcagctcattatcaccacgccattctttctgattaaaaggcgggtttgccataatgtaatctgccttgaggtccttgtgctggtcattggtgaatgtgttcgctgccatttctccgaggtttgcagagatgccgcgaatagccagattcattttgcacagcttgtatgtcgtgtttgtatattcctgaccatagatagagaccttcttcttgttgccgtgatgtgcctccacgaacttcattgactgcacgaacataccgccagaaccgcagcaagggtcatagagaataccgtcatacggctcgatcatttccgcaatcaaattgacaatgcacttcggcgtatagaactcgcccttacctttgccttctgcaagtgcaaacttactcaggaagtattcgtagactcgtccgataatgtcattctctttatcgccggtgttgatcttatcaatctcgtccagcagtgatgccagctttgctgtgtcgatgtgaagacgtgagtagtagttgtccggcagtgcgcctttcagtgcgggattcgctttctcaatcgtgtagagggcggtgtcgattttcagcgcaatgtcatcctgtttcgcattctccataatgaaagaccaacggctgatctcaggcaggaagaacacgttgtccttcgcatagaaggcaacattgtcaacaaacttctcaccgtatttttcagaaatagctttcctttgtgcctcaaacttatcgctggcaaacttcaaaaagaagagactgagaacgacgtgtttgtattccgctggctcaacagagccacggagtttatctgcggacttccacagagcttcctccatagaaatctccttcttcggtgccgatgcggctcgtgccatatcaaaatcctccctgtgtatttatctaacctattttataaaaagagctgtacgaaaaaccggactcagtttttgtccgttcgcacagcctcacatatatctccgatgtcacagttcaagtaatcacaaatgcgcagcaaaatagagagggacacttcttcccccttattcagttttgtccatgttccggcagacagccctacttcatgtcgtagagaagccttctttatgtcgcgttccagaagaagcatccatagtttcttatagcttatgcgcacggtaaccatcctttcgcttgcttgcattcaacatcgtttataatattatactggatttcattctcaaaaacaatccgttgatgcagaaattaaagaaaaagtttcaacttctcgaaccttctctcaaggatgcagggcacctccaatcaacagaagatgccctgcttttgacgagattattcgcgctgtgtgctgcgcagatgatcacggtcatggtcagcagagggagcgagaaatgtattaacattagacttgatcgtctctatttgctttacttcttttttgagcttcgcacgttcatcatagagccgctgttgctcttcaagaagtcgctgctgttccgcttgcagtgtcttcaagctcggcagtttttcatcgccctgcatggcaagcagcgtactccgcgccgcctcaaagatcagaagttcggcttcgtgctttgccttgaagctcggcttgtctttcgccttctggaaggcgtcatatacgggttttaggcgctggtagttggagatgtttttgataagcggttggacttcccgcagtcgcgcttcgacgcctttcagttccttgccggtgcggtcataggagctgtgaacgtcctcgaccttcttttcaagatcggcgtattggagcaagctgttttccgtgagatagttgagtgtccgtgccgcttccttgaggatagtgagctttgctttatgctcgtaacccttgctgtcgataagcctgatccgctcctgaatatctccgataagagagatgcccttcggcgcggcttgtgtctgacttcttcggggcgtccgtccggcaatccgctccttgatgcgttcctcggtgtagttctctccgatggtcttagaccgggtaaaccgctcctgaccttcagcgcggaaggagatgtatttgccggtcttgatttcataaccggcttcctgcatgagccgcagaaagtcatcgtagtccttcgctgtaatgacaagccggtcgatggtctgcttgagcttctgcttccagctcgtgccgcgtttggcttcggtgtactccttgtagctcatgcctttgttctgagagggagggataacagagagaccgttttccttacagagccggtcgctgacttcacgcatatcatagtaaatccgcttgtagctcttgtaggcgtggtagtccacaaagtcaaccgcattgaaaatcagatggttatgaacatggtccttgtcaatgtgcgtggtcagcacatactcgtattttccaccgaggatttcatccgcgaactgcttgccgatctcgtgggcaagctccggcgtgacctctccgatttcaaaggactggatcacatgacgggctatgatcctgaccggattcatccctttttgctcggctattttccgcgtccattcaaattcccgcgctgcggtctcgctggcacagccgtaggacgagaccagcagcttctcgtcggtcttttcgggattcagaatgtacgcgattgccttgctcaaagttcctcggattgctttgattttagtaactgccataccgcgtccatcttttctttcagctcgtcaatatcgtcctgatagaatcgtcccgtcgagttgatcctgcggcagacggtattgatgttcacaccgatcttgttgatttcggcggcgagctttttctgctccgtgtagtccacaacgatgatgtagccgtcgatcagcatcttccttgcatacgcaccgaagttctccgtgccgatcatctccatcttctttgcaatcgtccgttcttcctgtggtgtcagccaaatcttcttctgaatgtctcgtgttcttcgtaccatgctgcgccctccgtcgtaaagattagaagggtttgggactatcccaacaagcaaaaatctgatgttaagggcagggtctccttaactgatttttctccggtgggtactcaccggatttgcttgctaatctcccaaaatcgtattccccgaagattcccccgtgaaatgtcccttcactttacaacggacacaaaaagggcgtttgttgagtaccggatttcaaaaaagtcaaaaaatcattggatttcccatgtgaaagccactgtgtctgtcacatcaatatcaaccggctcaatctcaggtgcggcgcacttgctcatcgccatgagaggctgaatgcagtcttcaacatcgtagcttgttctggaaaaaacattgagttcgccccagttgtagtcgatgttgtgcaactgcccaagcgtactgcctgatgctttgcaaagaatctccgcctttgccctggcgttctccgtcgcattgatcagcagctcttcgctgactcttgcccggtttttcacggtgaacgcaatgctgagttctggttgcgccccacaatccgcaatcgcagaaatgacctttgcaagttgcttgctgtcaaagtcaaaggcaagtttcaagcgatagctgcaagcatatccggcaaactctcgcttgtaatttccttgccgatccttgacattctcgtaccttgtctggacatcaaagctcgtggttttcaggtcttccttgcgatacccaacgcggactgcggcaccttgcagtctttcgattctctcggcagcttccgacattgcgcggtcataggtttcagataagactacaatgttcagggataggatgatgtaatccggtcttgcggagacattgcctgtcccttttacggtgattattctcattactttctcccgtcctttctggaattgtagtcctcatcaatacgttttttccaattcgtacccagcggcacgctgcatcggacagcggaaaccgcttcgctcagaacttcatagttgagttgcgttccctcgcggtcagagtggtaattgaccgctcgatctgctccaattccaaaatgctttgccgtctcaactgcatcaatgtttgcaccgaggaaaagaaactcccagccgtacttttccttctgtcgttcaatcatcttcttgaccttctcgctgtcataacggcggcttgcattctccatgccatccgttgtgatgacgaacagtgtgtgttcagggacatcctcttttcttgcgtacttatggacattcccaatgtgatgaatcgctccgccgatagcatccagaagcgcggtgcagccgcgaacggaatagtccctgtcggtcatcggctccaccttctgaaccggcacacggtcatggataacctcgctcacgttgtcaaagagaacggtagagatcaatgcctcgccattctcttttttctgcttttcaatcatggagttgaatcctccgatggtgtctgtttccagtccgctcatagagccgctgcgatcaaggatgaatacgatctccgtcaagttctttctcatgttttgtacctccgtatataaaaatatgactgcttggtgtctcaccttacagtcatattgtacttcggtattcacttcatttggtcgcatggcaagcgacattattctaaggacaagaacagctctccgtcaatgcttaggatgtcatccatcggaatcttcgtgccgtcctgcatggtaatcaggcgctcaaagtcatcaacctttatgactgcgccggttgcagttacatacgcaccgccagctttgcgctcatcaggtttgaagtaggttatttcaacctccggctcttcatcaagggcatccatgagaagctgatacctcatgttcaaagcggtcaaggctccctcatcaagctcaatcctttcgtcagtcagacgtccggtttccttgattgcagaatcatagccggtgagggcggcaaagggcgcaaactgcgctgcacgatctgacatcggcatttgtggtcgcgttttggaaacgtggtgaggaagtcccatgatctcgtcgtattttccgttcacgccttatgccctccaatctgcgcattgcggtctttcgcggttgcaccttcttcaagattcattgccttgaggatggcgttctttccatacttcttcttgatggcaagcgtggcggcttgtatcttccgctcacgctccaaagcggcatcttcggctttctgtttttcctcttcggcggcatagtcggtaaagaggtcgagctggactgcaccgtcgtttttcttcggtacatcagcttccggcaggacatgatttgcaacaacatacatacggcggacaagcagattcttatccacgatccggtcgaagagttctgacacagcacacattattttgcgagtagatgatgtgtgaccgtcgagattgatagagctgtgcgcctgtttcggaatctgcctcccataatgatctgtctcaaccgcgccgtgatactttgcccgtcgtgccggatcggtcaggttctcaatgtcgtagccaactgtgagaaccatctggtcggtgacaagccccttgtccaccaagtccagcacaagcaaatccgtcatttcccgcacaaccaacttcgccttctgcggctcgtagggacagtgcaatacctgaccggagctgaggctgttggagctgggacggtatgccttgattgcctcaatggtcgtaggctcccagccccacgcatggtcaatgagcaattccgcattcttcccgaagagcttgtaaagcaagtcttcgttccgctctgaacagagggcaacatcacccatggtgaacatcccgttctgctcaagtttcttggcaatgccccgacccacgcgccagaaatccgtgaggggctgatgcgtccaaagctcgtgccggaacttcatctcatccagctctgcaatacggacgccgttcttgtcggcggggatgtgtttcgccacaatgtccattgccactttgcagaggaaaagattcgtgccaattcctgcggttgctgtgatgccggttgtctcaagcacatcgagaatgatcttcatggcgagatcatgggcggagagcttgtaggtgttcaggtagtccgtcacatccatgaacacctcgtcgatggagtagaccacaatatcttccggggcaatatacttgagataaacctgatagatgcgggtgctgtactccatgtagtacgccatccgaggcggcgcaatgatgaagtcaatcgccagagacgggtctgcttgcagctccgagaagaagtgcgatgtgccgtccagtctgcgtcccggcgcgtcgtgctgccgtccggcattcgcttcctttactcgctgcttgacttcaaacagccgcccgcgtccggagataccgtagctcttgagggaaggagtgacggcaaggcagatggtcttatccgtccggctttcgtctgcgacaacgaggtttgtgtccagaggatctaagccgcgctcccggcattccacggaggcgtagaaggatttcaggtcgattgcgatgtaagtgtgttgtttcaccttctttgcctccgctttcttcttagatcagccctaatgacatttcattggagcttttaatgttgaatacgatacgccattcaatatcaccctccaccggttcaaagtgtagagaggaacaaactgcatgaagtttttcttttgagctgtctccacacacgattgcgattggaccgtccgctccgccgataatgccgatacaagcaatatcgtttcgtgcctctggtgcatagcggtcagagcatggcgcaatttccaaaggcttgtccccctcagcgcaatcacagatcgtaacatcgctgtcaggttcaggagaaagtgtatagctcatagcagtaaaatgcgtaggataaaaccagcggtcagaaccgtaacgcttttcggaaattgtctgctgctctaattcctgtacagtcaatgtgtatttttttccactgaccggatggaggaaagaaaacgaatcaccgggagcgtgtgccttgaaatgtggtcccgggacacgacacgactgctgctccattgtaagggagagggcttttatttcaggacggcgtttgcttgtccacggaaaagctgcccgaaaaatcatccatccataggatgtatccaaatcatagtgttccaatgcccactttgcttccgcttcattgatcaccccgtctggcaaacatggattaaagaccacggaacagccgtgggaggtcagcattgttttcccgttcaattccaaacgaggaataaagtcaaggcaaagtggattgtctaaatctatctgcatttgctgctcctgcgtgaagtattcgcaggagtcgttttcggggtgtaaatcccatttagttatgaacttgcgaatgtcttcttccggggtacgcatacaaaagtccatgacgagtcccttgctgcaagaatacgccgcaggaataacccaatgatgcctcgcccagtcaaattgcttattcaaccggatttccgttccggcatggtcttttcccgaatgtccccagaagtttccctcaaagtagaccttccactcaggcatggtcggttctgcttctgggttcatatcaacatcataatagtcctcggtgtacttgatcttactataatcaaaagatgcttgcagctttttgatgtatacccacggctgttccataggcgtcaatttcattttctcagcaagctctgatagcgttctttgctgatcctgcgttggagggttgtcctgcaaaaaggcttcaaactgggctttatcccacatccacgcctgttccagcgctgccgaatcactgcaagcaaggagcaacctcagaaagtcttcaaaatcgtttgccagcggatgaacaaaatccggagccgagttcatgggactgacggaaaataccataccgccaaagtctcgaacaaagcagaagtggatgccgtccacacccgcccagccaaaaatagatgcaccttttggcgtgcaaaagtatgggttgttatcttcacgacgctccacccctacgggcgaaaggtcaataccacttcgcaaaaatttctgaaacactttatccatagaccttatgctcctattaaactttggtcgaaggcaaacagagcctcgttgatctcaaagacattatagttcccatgctccacgaaatactccacgatgatgtcaaacttgttggagtgggagagcgcaaagccagccttcatgagcatatccttcatttcaacaagcggcagctcaagggcaatggcaaacgcaatgaccgtgggcttggaaggcttataagacttgtccgagcggatcttcgagaagagcttccggtcaatattcgccttcttatagcactgcgcgtccgtcatgccgcgctcatcaatctttcgcagaagcatctcggaaaaactctcgtcgatctgtcccagcgcgtcatcaagggttgccgcctttttgggggcagccgccgcagagacgggaggcatgagctgttcgattgcctcttcacaaacggatgcctcgcaaggcatgggttcttccatccggaaggcgttcatcctgcgcagacgctcggaacgattatcagtatgctcgtccacatagcggtcatctatgtacgctgcaatatcggcaaacagcttgccgctgatctgataggctttgcggtcaaaaatgacgatgtacaccgtcatttcgttttcgagaaggaaactgctaatggtgtcaatcgccactttgagagcctgatccttcggatagccgaaaatgccggaagaaatcagagggaacgcaaccgattcgcagccgtattctttcgccagcatgagcgaagtccgatagcatgagatcagccgttcgcgctcaccatgccgcccgtcataccagcgcggaccgacagcatgaatgacatatttgcagggcagcttatagcccttcgtgatttttgcgctcccggttttgcagccgtggagcgtttcacattccaccagcagctccggtcctgcggcacgatgaatgcagccgtccacaccgccgccacccagcagcgactcgttggcagcattgacgatggcgtccaccttcatttttgtgatgtcatttctgacgatttgaagcggcatgatcaagccctcccattcggttacttcgcgccggtcagcagcttgtccagcgggattctttccgggtattttccctcggtcagaatgtcatataaatacctgttatccagaatcatatcatcccggataagctgccagtttgcctttttcctgaaaaacaccttgaagatcaggaagttcatgatcgccccaattaccggcgtggtcatgccgaaagcctcggtgtgagagaaatggcatcctgttttggttcttttcccttcaaaggtgatgaacgccgttttcttgtcgctccggaatacaatgcggaagtggttttcatcctgttcgcattccgtaattgtgccggtcacatcgtagtccagccccatgacgatctcgcggaagcggatcttgcttcctgcgttatagtttccgttatagagattgcattcgatgtggtagggactccatttcacaaactcttcctcaaagttagcagtccatgcctttagtttgtcataggaagccggaatctctatctgctctgtaagaacaatcattgtcagtttctcctattctgtcaaagcggcatcggcgtccgggcaatcagaatgaccgccagaatcgcgcccacaaatgcagcagcccctatgactgccaacacctttttgccgagtttcttcttcgctgccttgcagatcagagcggcgcaagccatgcagacagccgccgctacaagtgcaatgcccagcgtttcccatagccaagatagttcatataggattttcacgcgatcatcatctcctgttcgttaaactggaatttgtctattcgtttgtttctctataaactgtcattccgagtattttaatttcgaacccatcaatatatggttttacaccatctacttctggtgcaagtcggtgtatttttgtaacctcatacactaatgctttatacctaacacttccgccgtcttttaagttcatacgaacaggggttaataggattactaaaacaactataattgcaattaccacaaagaatttctttttcatacaatcacactcctttgccaaatcccgatttatagtcttctcaaagtccaagtccatcaacccacgccgcaagctcctgatgcccgacattgcccttgaaaaccttgccgtccatcagctttgcgcctttgcagctcggcgcaaggcgctcgttcgtcttgccaatgtcgcttccgccggaggttgcaaacgggatgatcgtcttgccggtcagatcatagctctcaagaaacgtattgataatcgtcggcgcgacgtaccaccagatcgggaagcccacaaagatggtatcatagtccttcatgttgtcccgcttgacggcaatctcaggacgggaggcaggatcgttcatctcaatcgtgctgcgggctttcttgtccatccagttcagatcagcttccgtgtaaggcaccttcggctcaatttcaaagatgtctgcgccgattgcctctgccagcgtctcggcaaccttcgcggtcacgccggacgcagaaaaatacgctacaagtttcttgctcatggtgttttatcctttcaatatcttcgtaagctgctgtgcagatgcacccggcaggatggaggaaagatgctgcatcatgcgctctttggattcctgcgggtctcgctgatatgcagatgtgataaggtcgtacccgaaaagttcctccggagtcgcatactctgcgacaccccagccataaggtcttccgtatctgtcctgcatatagacgaaatccgcgatgcagacatagctctgcatttgcagccgcgtgatgcacgtctcaaaaccggtgttgccgcccttgcggtagttcagagtctctttcagccgtttggaaagcatcctgccttcaccggctatggcttcataaagctccttgtccttgtaggacgccaagccgtcatcccaacgggcgtcaaagtcatagccgtcacgccgaaagttcgcaaagtccggaatccactcccgactcacaaatccagccttcttgttgaaaagtttgccgtaaagacatttgccgctccgcgcagccggtcctttccattcccacggaccatctacatcatccgcaaaccataactcaggtgggcaaagttcctcgatggagaagccgtgaatctcgttccgaaagaagggcagaaagccgtattgttcgacggcggcaatcaaaccatctgcactatgtagttgtctggcatatctctttgacattactccgcctcttcaatcacgccataatcaatcaggatgttcttctccgcatactgcgggtaaacaacactcatcatctcatactgataacgtcttacgcggcgatgctcctgaattggttccggtgcgtacgcagcggtttcgcagtgcgcatactccggcatttccgcaagatcatcccgaacggcacggataagcgcgtctgccacatcatcaatgctcttgccgatttccacggcaaccagttcgtgcttccggactgccttgtccagattaccgggggagcgaaacagcttatatttcatatcattgcccgtcctttctctctatcggtctgtctattcttcctgaaatctgttctttagggacgcaatcatcgcttgcgcggcaatggtcagatataacactccaatttcatagataaagtcgcggtcgatcacgataaagtattctctaacgtgtgtaaaaaccagttccagcaagtccctgtacagtggatcatcaaagggcttgaaccgcgtaaacttgcttttggcagcgtcccatgtcatagacgcttcgccctcagcactggtcatcgcctcgcagagaatcatgctgacgcccatttttccgttgccggtcaggagttctccttcgtaatagctgagtaggtctttcttgcgtcgaagcggaactacatcgcagttgtcatccagctcaaatgcaatcagctccgcaattagttcccgccagaccgcataaccggcgttaatggttccgtcctcttcgcggctgatggtatcgtccatgcagtatcgctcaaagaaattatctccgtcaatctcgttgcgggtgcagaagatatgcgccagctcatgcagaagaatgtgcttcaactctgccggatgacgcgctatgtctgtgcgcagaaggattccgtccgcgccgtctcctgtgccgacgaatgcagaggcgtgaaagtcaaaatagccgtcctctgtatatcggtcttccagccggtcagggaaatactgcttgcagaactgctcaaagacttcctgctggttttccgtctgaaagcagcgcagtacaaggttgtcctcactgaactctgcccccaagcgttcgttaaagatggaagcggcatagaaaagggcttctttatagtcgtcgttgttcatctaattactatccttcatcctcattcacccctccggtctgacatttttcaggaagtcagagtgcggtacataaggcaagttgagctgccagcccatgcggttcagttcgttgagcttgatcagcatcaggttgatgtttgttcccattgcagccgagagctgcaccacatcgtagtcctgcttcatcaggtcaatcatctcatcatcgtcaatgatcaggtgtgaggcaaacgcattcgcctcatattcgtgttttgtgcgcatatcgaacagcacgaactccgggagcggttcgtttcctttggcaagatcacggtgaaaggtatcatgcccgatctcgtgaccgcaaaccatttgcatgatcagatactccatgttggagttcagaagaatatgccgctctttatggcggtaggtgtacattccgagcagatcgttcagattgtcaagaaaatggagatgaatgcccagctcacgggcaatcttcaaggtatctcttgttccacagcttttgacaatgctgttcgcctttttgtatatttcctcggagcgaattatcacgggaccttcacccctttcatgttgaaaacagtcaaagtaaatccgtcaagaaaccgagacgcagacagttattcctctgcgtccgtaccggtcttcttgtatttcttcggcgtgtatttctcaacattccgggctttggattcccaatatatatcctgcaacgccttcatcaccgcatccttgtcctgctcagacagcgtaccgcccgcaaacaagccggacatcccttcaatcaggtcctttgcctgtttcatgccacgggagccgtactgctcggatgcctgaaccacaaactcttcgtcctcggtcagcagatagttcacatccaccttgaagtattctgcgatttttctgtaagcgtccttggtacggggaaaggaaatgccgttctcgtaccgggtaatcatacgcctgttgatccccagtgcatcggctacttcctgctgggtcagcttccgcttctcccgttcagccttgaatttctctccaaacgtcattttggtaatcactcctgttcacaaaaagtttgcgacatcaaattgcgcaagtctattgacaaaggcacttgaagtgcgtataataatgactgagcaatccaactactcatagtatatcctgaattgctcatcctgtcaaggggcatgagtagttgtacacgaaaaagttacatcttttgagcagttcaaatggacaggcatttatgctgccgaagatcatccgtaccggcatacaccggtatgagggaacaggagtgagaaaaacagaaatggctacacagtacagaaaagcatacgtcccggttacgctggatgtggacaaggagggggcaatcctccctcgccttatctggtgggacaacggtgtaatctttcaaatcgaccagattctatacaaatgccgcgccacatccaaaaaggttgggggcggaggcatccgttacacagttcagattcgcggaaaggagtcatttcttttccacgaaggagacaagtggttcgtcgaagcaaaggaggacaactactcatgattttatcccagcgccaacttgaggaaattgcagcctcaacaacgaaggacttcaaccggttctttttcggggatgaggcggacaagcccgaccgatcagctttgccaacacccattgatcagtttgcaaagaactatctcggtcttcgcgtatcattcgcccgtctctcgccggacggaagcatctgcggtgtcactgcctatgccgacactgagtacaagatcacggaacttggtattacgcgcacactggctttgaagcgtaatcaggtcatcttggacgagagcttcattcgatccggcaacgtgcagcggctctgcgccaagcgcagatttacccttgcccacgagtgcgcccatcagattctcttccaactggaatcggaagaggtaaaggcttcctgcgaaatgaaatattccgcacggacagcctatacgccgcgagagctgaaaacccgcgaggactggaacgagtggcaagcaaatgtcttgggcgcggcgatcctgcttcctcaaaaagaggttgacctggcaatgcgtcggtttgcagaaacgccgctgatcaattacgaggggaggtattcgtatggtgatcacttaacgctgcgccttttctgccggttgttcggtgtctccaagacaacggcgtctatccgccttcgtcagctcggctacatggtagatcgtccattcagtgagtatgttgacccattggaggtgtggtaatgaagagagcatccattcgggttcaggaaccgacgccggagctgatcgaaaaaatccgcagggcaagagttgccatttcccagcaaaagccccgatacctgaaatgtccctattgtcagcataatgccattgctgtctacgaggacacgagaggtcatgtagaatccaagtgcaagaaatgcgggcggatcacagtctttgatgtgctgaatatgagaagactgcgaccgcgtaccaagtaaaaaccggaggacaagcctctgttctaaaataaaatatatgtcatagctgagctgtggagccgcctgataggtgaagtcatcctaatgccgcatgagacagagtttaattgctctgttttatcggcatgggattcaaacctcaccgtcatgcggctctttttctgtcttcacccttcccgctgctcccgcgcagcggaaaggatgaacaatgaaaatccctaagacccctatcgcgttcgattacgacctctggactacggaggacggcaagtgcatggtgcgcgtgaaacgaaccggcgaagtttccgaggttgaccgcaaggttatgagaatccttcgcgcagaggaaaagcggatcagacgctcgtatggctctgacaacacctctgaggatgaggacggcgcagagaaaatttctgataccgtgctgtcccttgacgctatgccggaggacgatgtgaagtccgctgcatggctggcagactcccgcgactgcatggaggaactgattaccgccctcaaagagaaggagcttctttccattctgaccgagaagcagcgcgaattgtatcttgcgatgacccgtgaaggactgactcttcgagagtttgcccgaaggaaaggcatcggcatcagagctgcatttgacctcaaagcagcggtgcagaaaaaatttcaaagaattttttgagcggtactcaacaaacggcaaaaagatgtccgttgtaaagtgaaagggtcaatcagaccacttcactgctccttgaaaactgaatagttcagtgctgcggatctttccgcttctgcgaagcaacacagcttccgacgccaagacctcccgaaagggagtgagcgacctccggagagctataacagtcgtgtggtgcggctgcttgcgacgatgcagatgccgggtataatgatacttccgtcttttctttgaatgggcggctcggagcgatcctcggaggggtgagagtcccatgataccgattgaccattggtagtccgcagcattcccggaactgcaaagttcttctggcaggggcgcgtgctgcaaatatgccggacaatgaaacaaacccaaaagaaacttactatatagtttcaggatgaaaactatgtggcagggtatcttcacaagatgctctgccatatccttttgtcctgaatattttcacgaaacaggaggtgcttagaatatgatgggcattgaaacaatgaaaaatgtcagcccgaaaacggttgaccgaagcacactcgttcagagaagcagcatccggcttgatcctgcggcaccgcgagaggacaggctgagggagttcattaagcagatcagaaatccctactgttatctggacgggaaaactgtggtgaagatcagcttcaccgagacggatacgacaatggaagattgtctggaacactatctgagaggtctttgatttatgaacagtctgaatcttttcgcccggttctatggacaagcgattgagcctgtggtataatttaatcggtcaaaaaaagaagaatacggattaagccgcttgccttgatggtcatgtggcgttttcgtgttcctcttcataagagttgaagcaagccttcgtctttctgatttgatgtaccacaccaaacagaaaaacggaggttatttttatgccagacaaggtttaccgcacggcgatctactgccgtctgtcccgtgaggatggagacaaagtagaaagcaactccatcgccagccagagagccatctgcgaggactatatcgcaagacatgaggatttggagcttgtctgtgagccgtttgtggatgacggttacagcggcgtttccttcaatcgtcctcagttcaaaaagctggaagaggcaatccgcaagggtgcgcttgactgcattgtagtcaaggatctcagccgcttctcaagaaactatatcgacggcggacgttacattgagaagatattcccgcagctcggcatacgcttcatcgcaatcaatgatgcgtatgacagtctgaccggtgatccgcagtccgactcctttgttatcccgttcaaaaacttgattaacgattcttactgcaaggacatctccatgaaaatccgaagcagtctggaagtcaagcagaagagcggtgagttcgtcggttcgttcgccccttacggctacatgaaatcgccggagaacaaaaaccagctcatcgtggatgaagcggtcagcgaatatgtgcagatgatcttttccatgtacaaggacggcttctccattgggcgcattgcaaagcgtctgaaccagatgggcgtcctgtccccaatggaatacaagcattccgccggtgtgaagtttgataccgtcttcaaaaccggcgataccgcaaaatggacgtacaaagccgtccagcgtattctcaccaacgaggtttatatcggcgttctggctcagggcaagcgcggcactcccaactacaaagtccgcgttgtgaagagcaaggatgaatccgagtgggtcaaggttgaaaatgcgcatgaagctcttgtgtcctacgaggacttcatggcagtcaaggtcatgatgcagcgcgatatgcgctgttcgcccgatcaggacgaagcgcatctgttttccggcttcctgttctgcggagactgtcagcagccaatgatccgcaagaccgtcccgtcgaagacgaaaaagtacatttactacgtctgctccaccaataagcacagccggacgtgcagcccgcacagcatcgccgcaaaagaggttgaagagaaggtcttccgtgccattcatgaccagatcgagcttgtcatcaatctggaacacgcgcttgcgatgatagaacggcttccgtctcagagccgtaaggctttcaattacgaagctcagatcgccaaaatcgaggaagagattgaacggtaccaaaagctcaagctggggctttacgagaacttcatcggcggcgtcattgataagtcggaatacttcgagttccgcaacagctacaccaaaatcattgagggcaagcaggacgcgcttctgcgggttaaaaaagaaatgaagcagacggtgacaaccggtacgactgaacgaaactgggtgatgcttttcaagcagtatgaaaacgtcgaagagctgaaccgccgtgtgctgatgtcgttggttgaccgcatcctgattcacgaaaaccatgcaatcgaaatcgtcttcaaatatagggatgaataccagcagacgattgaatacgttctcggctatgccgatgaactggatattgccgtataaaggggggatgagcaaatggcaagaaaaagcagaaagcaaattgcagttgaagagccggttatcgagtctgtttcttccgaggtcttctcaacagccatctatgcccgtctttccgttgaaaacagcggcaagtccgaaaaggtggatgtcatcgcaaatcagattgagatttgcaagtcctacattgcagagcgtccctacctgaatctgatagatacctatgtggacaacggacgaacaggaacggtttttgatagaccggagttcaaccggctgatgaacgacatccgcaccggcaagatcaagtgccttgtagttcgtgatctcagccggttcgggcgtgactacatcgaggctggaacctatctggaacgggtctttccgcagatcgggcttcggtttatcgccatcaaagagaactacgacaactttgatacggacggctccggcgaaagcctcatcatccctctgcaaaacatgatcaacaccctttactcgaaggacatctcccgcaaggtttctactgcgctcaaagcacagatggaaagtggagagttcaagaagcgcaatctcccgtatggttatcgctgggatgaggaacacagcaatatggtcttcgatgaggaaaccgcgccgattgtccggaagattttccaatggaagattgaaggactgtcccttcctgcgattgcagaccggcttgatgcaatgaatgcgcccaatccggagtttcagaagtatcaggtcggcgtccgcacaggtaatgctacggcaaagaagatttggaacaagtcttcactcactaccattctggataatccccattacgtcggagataccgttctcggacggacgctgaacgccatctacaagggcgtcaggaatcagcatatcgaccgcgaggaatggatcgtctttcccaatacgcacgaggcgattatctcccgtgaggacttccagaaggtacgagaaatgcgcgacgctgctgcaaggacaagagttgagaagatggagcgcacggaggaaatccgcgctacgctgatcaatctctttgaagacaaaatcgtctgcgcagactgcggcaggaagctctatttccatcgcaagcgcgttgacaagcgtaaggacggcgcatggtacgccttctatgagtgcagttcatccgtcaagcgcggcaatctctgtacgccacactatacgcggcaggacaaactcgaagccgatgtgcttgcggcgattcagcttcaagtcaaggcggctctcaattacgacaagctgcttgccaaactgagaaacagcgaaggtgaacgcagcatccgagatcagcagaatgcgctcattacaagcctgaatctgaaactcagcggtatttccaagaagcgtacccgtctctatgaggacttcacggaaggcgttctcgatgaagaggaatacgcctttgccaagaaagcctacgatgagcagtatgccgatctttcacggcggttggatgaagcggttcagcggaaggtaaagtttgccgaggcaatgtccgaggataataagtggctcacgctgatgaaatccgtcagcggtacaacgatgctctctcaggagttggttgacgagtccgtagagcttgtgaaagtccatgaggacggctcaatcgagctggtcatgaaatacggcgatatttacgctctgaccgttcagagtatcaaggaagtacaggaggcgatgtaaatgagcaaggaatacaacatcggcatctacatccgcctctcaatggctgatgaagatactggctatggcagcaaggcggaaagtgacagcatcggcaaccaacgtatgctcctcaatcgctttcttgacaatcatccggagctgtctcgctgtcagcggtctgagtttgcggatgacggttataccggcacgaactttcaccgtcctcaattcacgcagatgatggagaaggtcaagcgcggcgaaatcgatctgatctgcgtcaaagacttttcccgcttttctcgtgactacattgaaacgggaaactatctggaatgcactttcccattcatgggcgtccgctttatctctatcaatgatggctatgacagcgacgattacaaaggcacaacgggcggtctggaagtggttatgcgcagcatcatctatgcggcatacagcaaagacctctccgtaaagaccacatcggcaaaaatccagatgatgaagcaaggcaagtatgtcggtggctacgctccatacggctacgtcctgcatccaaccattcggaacaaacttgccgtagacccggaggcggctgatgtgatccgtcgtattttccgcgaggcgctggaaggcagcaacacctctcagattgcccgcagcctgaatgatgacggcatcccgacgccggggcaatacttcaagggcaagcatcccgacaagaagaagttcagtaacatgagcgagaaaatcagttgggaaaccgtgatggtctataacatcctcaaaaaccttgtttacaccggaacactggtcagccgcaaaatgaagtcctgcggtgtcggctcaaaaaagcgtgttgtcaatgagccgattatcgtagaaggaacgcatgaagctattatcagcaaggaagactttgagcttgctcagaaggtcattcgaggcggaggacggaatcccacgcgcaagcagcatgactatccgctcaagggactcgtccgctgcggtaactgtaaacgtgctatgacacgccgaaagaacaaggctggcattcgatacttccagtgcattcactcggtcaacaacggaaacacagactgtccggttggcaggagctttccggaaatggatattgagaaggttgtcctccatgcccttactcagtttcttgctttggcacagaaggaagcaatacagaaccgcgaagtcggtgatctgcggaaatctgccatcaaggaatgtgctgataaaatccgcactctgcaaaagcagaacgagcagaacaaggcgtccaagctgaggctctacgagaagtatgcagccggaagcatcacgaaggaggcgtacattcagcagaaggcggcagcggatgtgaagattgctgaaaacgatggagcaatccagctcagtcacgagcggatgaaggagcttgactccgagaccgcctgttcagatgaaaagctggatgcggtctgcgaacagtacgccgactgcaaagctctgacctatgagctgacccacgcattcatttctgcggtctacatttacgatcttgacaacatagaaatcgtctggaagttcaaggacttcctcactacatcagaaggagaagccaaatgaaagtatttctttatatccgcgttgcctgtgcggatcagcttgcggcagcagaccagcgggaagagctggaacgctatgcgaaggacaaaggctatgaggtggctgctgctgtggcggcagacggcatctccggcgtccatacggaaggtatcatgaacttcctgctgaacgaagccaagcgtcaggacatcggtacgatcctcacccgcgacacctcgcgaatcagccgggacacttcctctttcatgaggtttgagcgaaagttccaggagaacggcatccggttcgagtatctgtccaagcctgacaacgagcttccggtcactccgatgttggaggcatttgcggcggcgtataagaagcgtcgcacaaagaacggcacaagagcgtagagaaaacgcaagccgttcacgggtggttgtccacctatgaacggcttgtaaattctcaaaatttttttagtccctacttgacacaagaagatatgtcgagattagggcgaaactacctgcaagtgggaatgtacacggaaatggttttcccacagaaaggcgtccgcttcatcgctatcaatgacggagtggacagcgcacagggcgacaatgactttgccccgctgcggaatatctttaacgaatggctggtgagagatacgagcaagaaaatcaaagcagtaaaacgctcaaaaggtatgagtggcaagcccatcacaagcaaacctgtgtatggctacctcatggacgaggacgaaaatttcattattgacgaggaagctgcacccgtagttaagcagatatacaacctctgccttgccgggaacggtccgaccaagatagcccgtatgctcacagagcagcaaatccccacgccggggacgctggaataccgcaggacgggcagcacccgccgctaccaccccggctatgagtgcaagtgggcgaccaataccgttgtgcatatccttgaaaaccgggaatacacaggctgcctggtaaacttcaagacggaaaaactctcttacaaagtcaagcacagcgtagaaaatcccccggagaagcaagcgatattcgagaaccaccacgagcctatcatagacacccaaacatgggaacgagtgcaggagcttcgcaagcagcgcaaacgccccaaccgctatgatgaagtgggcttgttctccggcatactgttctgtgcggactgcggtagtgtcatgtatcagcagcgataccagacggacaagcgcaagcaggactgttatatctgcggcaactacaagaaacgcacccatgactgtacggcgcactttatccgcaccgacctcttgaccgctggcgtactctccaatctgcggaaagtgacaagctatgcggcaaagcatgaagcccggtttatgaagctcttgattgagcagaacgaggacgggggcaagcgcaggaacgccgccaagaaaaaggagctggaagccaccgagaaacgcatagccgagttatccgctattttcaagcggctgtatgaggacagcgtgaccgggcgcatatcagacgagcgtttcacagagctgtcggcagactatgaagcagaacaacgggagctgaaagaaagagccgctgctatccaagcggagctttccaaagcacaggaagccaccgtgaacgcagaaaagtttatgaatgttgtccggcggcataccagctttgaagaacttacccctactctgctgcgggagtttgtagagaaaatcgttgtgcatgagtgcaactatgacgagaacaagacccgcagacaggacattgagatttattattcttttgttggcaaggtggacttgcccgaatgaccgcccgacctatccgatatcaaaggcaagtatcggataggaaaggcaaaaatttttacacttctattacttctttatcacacataagcaaagagccagggcgcaaagcagctcgcagctggcggcggcatcatgctgctgggcgtgaaggtcatccccctcatcaccacgctcatcgccgtgtaattggtgagcgcctatggatttcatattcgacgcgatcaatgaatggatcaagaagttcctgatcgaagccattcaggggaatctgtcgggtatgtttgatggcgtgaacacccgcgttgccgagattgcgggcgaagtgggaaaaacgccggaggcatggaactccggcgttttctccatcatccgcagcttgtcccaaacggcggtcctgccgattgccggactggtcattgcggcgatcctcagctatgagctgatcagtatgatcattgacaagaacaatatgcacgacatcgacacatggatgttcgtcaagtgggtgttcaaggctgggatcgccattttcgttatcaatcatacctttgacttcatcatggcgattttcgatgtcacacaaaacatggtgcagaaagcgaccggtgtcatagatgcgcaagcaaacatcgacattacagcggcgcttgcgtctatcacgacagagttggaagcgatgggcacaggcgagctgttcggcctcatgatggaaaccttcttgatgcgctttgccctcaccgtgatgggcgtgtgcatcatgatcatcctctatggcagaatgatcgagatcttcatttacgccagtgtcggaccgctgccgtttgccaccttcgccaaccgggaatggggcaacatcggcacgaactatgtgcggggccttgcggcattaggcttgcaggggtttctcatcatggtctgcgtggcgatctacgccgcactggtcaagacgctatcccttacaggcggcaatatccacgctgcgatctggggatgcgccgcctatactatgctgctgtgtttcagcttattcaagtccggcggcgttgcaaagagcattctgcacgcccactaaaaggaggaattgattttgccggaagtttatatcccaaaggatctgacgcaggtgcagaacaaggtcatgttcggcttgacccgccgccagcttgtgtgtttcagccttgcggcagtcgtgtcggttccgatctatctgctgacccgcaagccgctgggcggcgatgcggcgatggtgctgctgatcgtttcggccttgccgttcttcttcacggcgctgtaccgcaaaaacggtcagccggtggaacgatgcctgaaaaactatgcccgcgttcggttcctgacgccccggaaccgtccgtatcagaccaacaaccgccttgccgtactggaacggcaggcaaaaatcaacgaggaggtggagcatattgctctctatgaacagaaaaaacagccggcctttgcgaaaaagcgtcggctggagcagcgacctgatcgtccgaccggacacgccgctgacaaacgcgcagcgcaaagagttcgcaagaacggtaaagcgggcaaaacgcgacggtaagattgccgcgaccgcccagcagaccattccctatgtggaaatgtaccgcaacggtatgtgcgaccttggcggcggactgtacagcaagagcgtccagtttgaagatcgcgcatataccgaggtgtcggatgatgaacaggtggtcatcttcgacctctactgcgatctgctcaattacttcggaccttctgtaggtctggagctgtccgtcatctgctattacccggatctcaaaagctatgagcatgatctgagcatcccgccgagtggcgatgcactggacccggtgcggcaggaactcagcgatttcctgctgcatcaggcggcaaagtgcaaggtcgagcgccggatgtgcctgacctacaccgtgcaggcggagggtctggtgcgggcactgtcccgtctggaccagatcgagagcgatgtcattgcggcgttccggtcgcttggcagcaccgcccgtccgatggatggctatgagcgtctggcggcgctgcatcagtgcttgcatctggatacgccccagcagttcaaattcaactggaatgccttgatccagaccggactttccagtaaagactttattgcacccagctcatttcagttcaaggacgggcgctatttccgcgtgggcgcatcctatggcgcggcatcattcctgcaaatcgatgcaagccgcctttctcatactctgctcaattcactgctggactgcgatgcctgccagatattcaccatccatgcaaaggcattggagcatggcgcggcgctgaaagccgtcaagcgtaagctgtccgatctggataagacgaagatcgacgagcagaaacgcgctacccgcaccggctacgattacgatattctcccgccggatctgaaaacctacgcaaaagaagcggaaaatctgttggaagcgttgcagagccacgatgaaaagctctttatggtgacgatcctcatggtgcatatcgccccaagcagacagaagctggagaacattctgacctctgtgggtggcatcgccagcgccgcgaactgcgaactcattcgactggactatcagcaggagcagggatatatgtccgcactgccgttgggtgtcaatctggtggagatccaacgcggcatgaccaccagtggaacggcgattttcctgccgttccgcacctgcgaggtgtaccagccgggcggactgtactacggcgtgaacgccctgacgaatcagattatcatcgcagaccgcaagaccctgaaatgtcccaacgggatcgtgctaggtacgccgggttccggtaaatcgttcttcgccaagcgtgagattgtccacacctttttcacaacggacgatgaccaactcatgctggacagcgagaacgagtacaccgccctcaccgaagcgctgggtggtcaggtcatttacctcgcgccggacagcaagtattacctcaatccgatggatattgacctcagcaccgatgtgggcgaatcgcctatgctgatgcaggcagatttcatcatgtcccagtgtgaactgatgatggcaaatcagggtaataccctgatgcccattgagcgatccctgctggaccgctgcatcggattggtgtaccgagaatatatgaaggatcccaaaccggagaagatgccggtgctgggtgatctgtaccgtgcgctgaaagaacagcacgaccccagagcagatgatctcgccacggcgatggagatttatgtgaccggcagcctgtcctacttaaatcaccgcacgaacatcgacctgcataaccgccttgtgtgctacaacacgagccgattggggcaaggactgaaaaagctggtcatgagcaatgtacagaaacacatctggcagcgcaccacagcgaaccgttacgccggtaaaacgacccgcatcattttggacgagttccatctgctgctgaaagagccgcagacggcggcgtatacggcggagatctataagcgtttccgcaaatggaacggcattccgaccgccctgacgcagaatgtgaaagacctgcttgccagtcctgaaattgaaaatattctggaaaacagcgactttgtgttgatgctcaatcagggcgccagcgaccgcgcaattctggcgcagcgactctccatcgcgccggatgagctggctcatgtcaccaacagcggcgagggtcagggactcttattctttggggataaggtcattccatttgaggaccgtttcccgaaaaatactaagctgtaccagcttatgacaacgaagcctgcggaacaggagccgaaaggaggtccccatgcagactgatgtgatctacaacatggacgcactggaagcacttcgcagcttgccggaggaaagcgttcattgctgcgtgacctcgccgccgtattatgccctccgggattacggcgtggagggacagatcgggcgggaaagtacgcccaaagagtatgttgcgcgtctgaccgaggtgtttgccgaagtccggcgcgttctgggttcggacgggacgctgtggctcaacatttcagatacctttgccggaaaaggcaatcagggtgatgcgctggacccgaagtatcccaacggcaggaccggtcagactgtggcactgaaccgcacggtagagggctgcaagtccaaggatatgatcggcattccgtggatgcttgccttttcgcttcgcgcagacggctggtatctccgcagcgacatcatttggcgcaaaggcaatcccatgccggaaagctgcaaagaccgtccttctcgctactatgagcatattttcctgctgtcgaaatcccgaaagtatctctataacgccgatgcgatcgcagagccgctggcttcgtcctctgctgcacggtataggcgtaggtgctgcggcggcaagtatgccgaaaaggtgccgggacagaacaatgtgcagggactcaatctgatgcggaccggctcatactatgcggacaaaccggaacccaccatgcggaataagcgggatgtgtgggacatcaacacggtatcctatcgcggcgggcattttgccgcctatccgcccaagctggcggaaacctgcatcctggcaggctgcccggagggcgggatcgttctggacccgttcttcggctacggcaccaccggtgccgtagcgaagcagcttgcacgacattacatcggaattgagctgaacccggagtattgcaagctggcacagaagcggatcgaggaggcatccgcatgaagtggaagcgcaatatctacgatgcggatgacgccgcccgcagtaagcgcctgaaattcacgccggaggaacgggcggaaaacgccaagaaaaaagccgaggtgctgggcggtaagctggagcaggcaaagcaagatttgcccaaacagcgccgccctgccctcaagcgcaccgtagacccggcaaccggcaaggtaaagcacagtgtttatctggcggaggaagtaaagccccgcggcaagcgcagtacagccggtcgcgtagtaacggcttccggtcgcatggcaaaccggcagctgcaccgcaagctgcggcaggtggagcaggaaaatgtgggcaccgaagctgcccacaagacggagtttgtgaccgagcgcacagtaagcagcgccgtccggcatgggcatcgctatgtcaaagacacaccctaccgcaaggtggaaaagttagagcgcaaaagcaccaaggcgactgtggaggcgagataccgggaagccattcgggataccccagagcttcaggagcacactttcaaggcacagcttcaaaagcggcggctgaaacggaaatatgccaaggaactccgcaaggcgcagcaagccgtaggcggtgcgaccgtgtgggaacgcgcgaagaacgccgtgaccggtgcggcgcagactgccggtgattttatcgtgcagcaccaaaaaggcgcactgtgcatggcgggcatccttgcgctgatggtctgtctgctgatgtccggactgtcctcctgttcagctatgctggagggcgtgaccggtgcgatcaccagcacctcctacactgccgaggacccggatattcgtcagacggaatcggactacacggcactggaaaagcagttggagcgcgaactggacagcatcgagcagacgcacagtggttacgatgaataccgctatgatgtggataccatcgggcatgaccccaatgagctgatcgcctacctcaccgtgaacttcaatgacttcaagcctgacgaggtgcaggcggcgctcaaagacctgtttgagcagcagtacacggtcacgctgacgccggtatccgaaacgcggtataaaactgtgagccataccaacaaggacggcacaaccagttcaaggcgtgtggcatacacctacaagatattgtttgtgaccgtccgcaatcgctcgttgggaaccgttgtgcgggagctgctgaccgaggatgagtataagcggtatctggtgatctttcagcagaaaggcaaccgaccggatattttcggagataacatctacgcaaacccgtccgagggaccgaagtatgagatccccggtgaagcactgtccgatccatcgttcaaggcgctcattaccgaagcggagaaatacttggggtatccctatgtgtggggcggctcgtcaccgtctacctcgtttgactgctccggcttcgtgtgctgggtctacacggccagcggcgttcacaatctgccgcgtaccacggcgaccggcatctataatcagtgtactgtcatctcgaaaagtgaagcaaaaccgggcgaccttgtgttcttcacaaaaacctacgattgcgacggtccggtgtcgcatatcggcatctatgtgggcaacggcatgatgatccacgccggttcgcccatcaaatacgccagcatcgaaacctcatactggcagaaacatttttacgcatttggcaggctgtgagcctgtcttttttgttaggaggcattgtatgaatcccagaatcaagaagatcgaacaggaaattgacaagctcaaaggcaaggtcgcatcgtatcagatgcgctgccgagagctggaacagcagaagcgcgaactggagaacacagagatcgtcggcgtggtgcggagcatggatgtttcgccggatgagctggcggaggtgcttcgtgcgcttcgcagcggcgcaccgctgccgcagaaccatctgaacaaggaggacaacacccatgcgaactaaattccgtaccttggcggtcacactgatgaccgccctctgcatgacgctcttttgcgtccctgctttcgccatgagcgaggaaccggcgcagtctgctacatcttccgcagaggcgaccacgtccgctgatgcagaaaccggcacttcggccaatcccttcacccccaacggcacgggtacggtggtggataacgccaccgacgaggacggcaaggagttttacaccatccagaccgcggatgaaaatgtgttctacctcgtcattgacaagcagcgcggcaccgaaaatgtgtattttctgaacgctgttacggaaagcaacctgatggcgctggcgaaaaaggacgattccgctgcgaccgcgccggtcgagccggaacccacgccggagccggaaaaaccggcagacgaaccggcacagccggagcagcctgctaagaccggaatcagcacgggcatgatgctgctcatcggcatcgtggtgcttgtcgcaggcggtgccggttactatgtgaagatctacaagccgaagcatgaactggacgacgcggaggattgggacgatatttcctttgccggaccggaggacgaacccgtggaggaggacttttctgaactgaccgccgaggaagaagccgaacgccgcagacgctatgaggaagatgcagatgaggacgaggatatggacggtgacagcgatgcccctgttcagtaaccgtccgggcatggagcgcatgatgcagcagaagcctgctggtgggaaagagccggaaaccccggctctcccgccgaagcatccctgccatggctgcggctatggcaggcagcgcccgtgcatcgggatctgctataaagaactcatggaacagcactttgggaggaaacaggaatgaaactcattataaccgagaagccgtccgtcgcgcagagcatcgctgcggtgctgggcacacggcagcggcaggacggctatctggagggcggcggctatctcgtaagctggtgccttgggcatttggtggaaatggcggcggcagacgcctatgaccccacctattctaagtggcagatggacgatctgcccattctgccggagccgtggcagtttgtcatcacaccggacaaaaaggcgcagtttgccgtactgcgaactctcatgcagcgggacgatgtagagagcatcgtgtgtgccaccgacgccggacgcgagggcgagctgattttccgcctggtctatgaaatggcgaactgccgcaaacctattgagcgcctgtggacctcctcaatggaggaaagcgccattgaggacggttttgccaatcttcgtcccggtgcagagtatgattcgctctatgcggcggcgctctgtcgttccaaggcagactggctggtaggcatcaatgcaacgcgcctgttttccacgctgtaccatcggacgctgaatgtggggcgcgtgatgacgcccacccttgctctggtggtagagcgtgagagcgccattgagaacttcaaaaagcagaaattctacacggtggagctggactgcggctttcgtgcggtgtcagaccggtttgaccagcgcaaggacgcggacaagctgtgtgccgcctgcgagggacagtccctcaccgtaaccgctgtggagcagacgaagaaaacagcgcgtccgccgaaactgtacgacctcaccaccttgcagcgggacggcaaccgtctgttcggctataccgcccagcaggtcttggactacgcacaggcgctttacgagaagaagctgttgacctatcctcgcacggattccaattacctgaccgaagacatggcggacggcgttccggctcttgccgagcagtctgcaacgctgctgccatttgcgccgccctacgcgatcacagatgtggggcgcgttgttgacagcagcaaggtatccgatcaccatgcgttgctgcctaccatgcaggttacagaggatgcactggcgtcactgcctgccggtgagcgcaatgtgctgacgctggtgatggtgcggctgctgtgtgccattggtaaaatccatcagtatgaggatactgctgtccggctggagcaggacggtgtagtctttaccgccaatgggcgcacggtgatagaacccggctggagggcaacggagaaagcgttcctctccacactgaaacaaaaaccggaggcgagcgaaccgccggatacgctaccgccgctgacacagggacagaccgtatccgtttcccgtgccatgacaaaagaggggtccaccacacctcccaagcactttacggatgtgatattttgtgagcgtaaggagtggataggaattgaagaaaggagttcagcatgagaagaaaaaaagataaaagcaatggcattactgctttgtatgaaagactgtctcgtgatgatgataatgctggagagagtaacagtatagttcatcaagatgtaatatgtagagggtggtttctaccgcctaatactattacatgactggcggctcatttgtggtgaattggtctggcagttgtgggaaaggaaaaaaatccgcataactgctgacattttagcacgaagggagcatgaaaatgaagtctatttttgaagaaatgggcggcacatatacgaaggttggcgattactatatccccgaccttgcgctgccggagaccgaggaatatcagatcggtaagtatggccgtatgcgccgccgctacttgaaagagcatcgtcccgtcctttatgcacactacctaacaagctgcaccctgcatgaacatcttgcagagatagacaaatcctgcaatcagcgtatggagatcatgtgcgaagctatggcacgactggaaggtgtgaccgaggcacttaaagctaccgatcaaatggaatgggtacggcgcatgaacaacattcataaccgtgcagaggaaattgttctgacggagcttgtatattgctaaacacatgttagccccgcatcagcatgaatgaacgctggtgtggggctaattctgtatcacttagctctttatattccagtagccttttcggtcagacccgatgcgctcgatgattcctttttccttcagctccttcagacgctgagaaactgtttttctgctgatagatagcttatctgctatggtggtagatgtgtatgcaggatcttcggaaatcagggccagaatttgcatggatttttcatccaaggtttctgttaccttttctgttaccttttctgttaccttttctgtcaccttgtaggtggcagatcgaataacccgatcctctgacgctgtaaactgaatcataatatcgccgggatgcacggtgtacgcaggaagcgggcttccatcttccttgcaagcctgacagattttctcaataccacgtccccagctctcgatgaagccggccaaataatacacattcgcaatcgccgtgttgtaagggcgggatgcgtgtttggacatcaggctgtctgccgtccagttgtctggaagcctaccacagttagcgatatacagcttatcctcatacacgctgatctgaatcggaacgccgctttcatattgcttgtggcatagagcgttaagaagggcttcacgcagggcagcgtcgggaacaaaataacgctcaatgcgctgcatcccttcgtaagtgattttcgctttcatatatttcagatggatgacttcaatgatcttgtcaatctgttccaacaaggagccgtgaatttcatcctgataacggagatcggcatcattctcgaaaaagccgatttttgtgtatgcgcccagctgccagcggtcagggtctttgcagaacagcagcatcgctgcgttggtataatacccggcattggtcagacgcagcttttccattaaatccgctttgtcctcgtctaaaacgctttggtcgatccggcccttcttggcggcaagggtcttgaatctcttgaccaactcatcatcaatatcatccaacgtaaatcccggcaagggcatattatcccacgaagcaccacgtttgcgtagaatgaagctctccagttctgggccagaaagggtctgcatggtgctgccgcttctataataatagacacctttgcagtttatggcaacgggatatggtggaacaacgatttccagatattctttcccgtcacgctccagctgattgacatccaccacgatgctcatggcatttcggattttgtttggaacatcctccagcagcttgcggatattgggcaggccgataacttttccatcatcgtcacagccaatataaatcttgccgccctgtgcattggcgaagccgcaaatccattccagatagtcatccttccacttagctttccattctatgttctgattttcaggcattattatcaccatcctctgatttattctttccccggctcttataaacattatactgatttttacaccttgcactgcaaaaagcggagttagcccggttactcaggaacactttctgacactgcttgcacatccgcaacggctttgtgctgtccaccagcatgaagctgaacatcatctgaatccccaacagcagggaatggaaatcccaatagatcgttggcctatccaacagctctatatgataggtgggtgcaatgccgccaaatgcagccatagacttacgcagcatattccggctttcttcctccatggaatcatagtcattataatagaagaaagaggtcagcatattaaatgcccaatccttgagttgctgtgccacccaatcgtaaggctctgcatacgcccgctggaagctcatggtctttgccatcggctcgtccataaaggtcatggtcagtgcaatcattgcccggtcgctggacacattccaactggattccacaccgttcttgaccacatccagcttatcaaaggggtaaaacagggacagatacttctccgtctccatcgtttcttccttgataaaatggttctttggcagatataccgcctcataatccataaaggacggcgtggtgggcagggccgtcatcaggcccagcagcccatagtgggtaataaattccaagattgccttttctacctctggctcagagcttttcttgccgttcatcatcagcatccccacattcagagcatccagcacaatgtccggggcttccttgagtgggttatagacatccggcctggcatcctttgccggggtgatgtatttcttcccgtccttgcctgttttgatttcatagcgttcataccgcacccaatgggaacgggattgctcaaaaaatgtattcataacgcaaatccttcctttcggtcatctgcttatcaaattcaatcagatcattcgctgtccttgctgctgccaagggcagctttctttttcctcggctttgatttgttctcccggaggataacggcgtccttgccataggctttcagcaaaagcccatattcctctaagaactgccgttcccgcagcgttaggcttccacagtcgttctgtttttccaaaaggtaatcataaaccgctctttgcagcttcttgtggatattctttcggagctttctaatgtttcggtctgtctgtccccgtatcatacccacctgtatggtgctgtactgccggatggacaggtaatacagcacttccttctgatcaatggtaaggctgcgtatcagctcagaaataaatgagcttgcaaccaactcatgcagttcataggggcaagaaaaaatgatatccagaaaattgccgctggcaagctggcggtatcgtggcagattcaaatacagcggaatcatcttcggattgggaactgccatgtattctaacggaacatctccccggagattttcatggtcacgctcccgtcgttcccgattccgatccaacctgtcccattcgctgacaacgtatcgaaagtcgtcctctgttcttgcagcatcctccagccgtgccaacgcctctgcccgtatctggcgctttaagcgtttttcgctgacaggagcagcttcttcctcttcgtcctccagttctacggtgtagtcccttgggttttcgtcctgctccagctctctttccagctctaaggctcgttcttcggagaggatttcctctaactgctcgttttgtatcgtcagatcggaggcttcatcccattcggttaggtcatcaccgtcatccgggaacaggagaaatgttctattttcatctgtcatgacctcacctccgaaaattttttgaatttctttcaaaaacagttccgatttacaccccggatttctcctattagtgagagggtaatctgataagcggttatttaggttactttttcaacccgtatcaagagaaaggaggacgcaagttgcggtagctttatgaaacatgacacaagatgccaccgacttacatcagtcggaaccaccattagtatatcaaacgaacatgaatttttcaaggaggaacgctatggataaaaacaaacaggcacagtatatgataagacgtattggcggcaccacctacaaggtgagagtcgctttcagtgaaagtgggaaagagacaatggaggataaaattttacgaatgatacgcaacgaagtagttacaaacgacggaacttgtgatataattggtgtaccacaaatgagccgtcagtctgaaaggagcgcatcatgagcatcattcagactgaggacaagatcaccgccttatacgaacgactttcccgtgacgatgaccagattggggatagcaactccattgtgaatcaaaagaaatacttggagggctattgcgcacagcaggggtacacaaactttgcccattacacggacgacggattctcaggcggcacatttgaaagaccggcatggaaaaagctggtggcagacattgaagctggcaaggtggctcgtgtgatcgtaaaggatatgtcccgaatcggacgtgactacttgcagaccggcttttacacggaggttatgttccgtcagcatggcattcattttattgccatcgccaacagcgtggacagcaacgaccagaacagcaatgaatttgctccgttcctcaacatcatgaacgagtggtacttgcgtgatctgagccgcaagcagaaaaccgctatccgtgtgaagggggaatcaggcaagcctaccaccaacagtgccatctacggctataagaaagacccgaacgacaagcaccattggttgattgacgaggaggccgccgccgttgtgcggcgcatcttccgtctgaccatcgagggaaaaggcccctatgacattgccagaatcctttttgaagataaggtagaagctccggcggtctattttgcaaggaaaggcattggcgtttggaaaagtaagaccgagttcgcatatccttataactggagcggctatattgtggggcagatattgtctaagcctgagtatatggggcatacggtcaatttccgttcccacaagctgtcatataaggacaagacctctattcctaatcccaaggaggactggctgatcttcgagaacacccatgaggccattatcgagccggaaacatgggagcttgctcagcaactgcggaaaacgccacggcgtattgataccataggcgaagccaatcccctgaccgggcttttatactgtgcggactgcggcgcaaagatgtataatcatcgttccagaggcggtacagaaggcactccgtatccgtcggatttctttgactgctcctcttatacactggcacatcagaagcatggaaaggactgctgcgggcactatattaccactaagtcgctgcgtatccttattttagagacaatccgcactgtcagccagcttgccatagcagatcgggaaaaattcaccgagaagatacgagccgcttcacaggtcaggcaggtggaggcggccaaagatgccaaacgaaagctgaacaaagaccgtaagcgccacagtgagctggatacgatcattaaaaagctctatgaatcctttgccgtaggccgaatttctgaggaacgctttgacagcctgcttgctgagtacgaagtcgaacagaaaaacctttccgcacagattgcagaaacggaggaaagcctgacgagctatgaggaagatactgcccgtgtagagcagttccttgctttggcagaaaagtacaccgatttctccgagctgactacaccgatgatcaatgaatttattgataaaatcatcgttcatgccccggagcgcatcgacggggacagaacgcaggaggtagaaatcttcctgaaattcatcggaaagtttgaacttcctgccccggagctgacagcagaggaaatcaagcggcaggagcagctacgccagcatcgcatcaaaagccgggagcgctatcagttgattaaggccgggaagcacaccgttgggcagccttttcagctaacctgtaagtgctgcggtcagggatttgaatccaaaagctcggctgctatgttctgcggaccgaattgccgggcgaagttctaccggcaggaagcggcagaaaacaggcggcgtgactgcacttgtgaaaactgcggtaagaccttttccaccacaagaagcaatgtcaagtattgcagtgatgagtgccgatatgaggggcatatcaaaggccagcgggttcgcaatgcagcgaacaggaaggaaaaactggcagcggagacagttacctctccggcttaatatttccaataaaacaataaattttgaggaagcggtttgccttatatcagggcaagccgctttttctacgcaaaggaggacacatgaatttattcgaaaccgtaaaaaacaacgtcagcctgcgggaagcggcacaggcgtatggccttgaggtcaaccggcacggcaaggcgctctgcccctttcacaatgacagacaccccagcttgtatgtggcaaacgaccattattattgctttacctgcggagagcatggagatgtcattgacttcactgcaaggttgtttgatctcaagccctacgacgcagccatgaagctggtgatagactttcatcttgacccggacaagccgcccagcgcagcggcactcaatgcaaagcgtatccgaacagaagcacagaagctcaaagaaaacgagcgtctgtgcttttctgttttatcggactattaccgttgcttggaggaatggaaagcatactatgcgccgcaaacgccggatgagccagtccatgatttattcgtggaagcctgccacaagctcagtcagattgaatatgaactgaacattctcacctttggtgacagctatgagcgtcgggaaattgtacaggactggatgacggatggtgaaatcatagcactaaaggagcgtctggaacaactgcgaaaggaggaaacctatggacgaattgaataccccaatggttatgccgcctgaagaaagcattcccgattggtatgatggaaaacgcatcaacgaagtgctgttttgtcagcagttcttaaaaaagcatcccatgaaatgtgtcagaggaaggctgttcacagtggatggactgattgaggacgaggcgcaaatcggcaatctcattctggaggagatctccggctgtctgacctccgggctttccaaggtggtggcaaatctgctggccagtatcaagctgcaagcctattcgccgcccctgcccatcgagactgaccgtatccatgtggcaaacgggacactctttctggatgggcgtttcaccgaggacaaaagctattgcaacaaccgtctgagtgtggcctatctccccgatgcaccgccgcctgtgcgctggctgcaatttttatccgagctgcttgtcccggaggacattcccaccttgcaggagtatatgggctactgcctattgcctaccacaaaggggcagaaaatgctcctgatgattggtaagggcggcgaaggaaagagtcgaatcggacttgtaatgcgctccatgctgggagataacatgaataccaccagcatccagaaggtagagaacaaccgtttcagccgtgcagacctggaaaacaagctgctgatggtggatgacgatatggatatgagtgccctgcccaagaccaactatatcaaatccatcgtgacctcagagtgcaagatggatatggaacgcaagggtgttcaaagctatcagagccagctttatgtccgctttctttgcttcggcaacggcgctttaaccgctttgcacgacaagtcagacggcttcttccgcaggcagatcgtgttgaccaccaaggacaggccagcaggacgagccgatgatccatttctggtggataagctgacacaggagcgtgagggcatctttttgtggtgtctggagggtctgcggcggttgattgggaacgagtatcagttcaccatcagcgatagagccaaagaaaatatggagacagtaaagcgcagcagcaacaatgtgatcgagtttttgcaatccgagggctatatccgctttaaggccgacagcgaagccagctccaaggctatctatgaagcctatctccgctggtgcgaggacaacgcacaaaagcctatgtcagcaaatcgtatcagctcagagctggcccagaatgaacggctttataatgtggaggctaccaacaatgtgtacgcagccggaaagcgggtgcgtggatttatcggagtggaggcgatgaacttgcttccttattaaatatgagaactggacttcaaaactgccgtacatgccgtacacgatgtacggcagttctcaactccgttttcaaaaagctattttaccgcaaaatcagcgttctttatgtgcaatgtgctgcgattaccgcattttcttgcggtataaacagcgatttgacaaagcaaacgcaaaatccaaagaccaatcggtgtacagcggcgtacagcactggcgtttaccgtacagagccgtacacaaacaatctattttcaaggccgcacagcggcagaaaggacaaactatgaactatatgaacaataaccctataatcatcggcatcgaccacggctatgggaatatcaagactgcacattgctgctttcctacgggcgtgatcatctctgacaaggagccgaccttcaaaagcaatctgcttgtctacaacggcagctattacaccgtgggcgaaggtcacaaggagtttatctctgacaaaatgacagacggtgactactatattctgacccttgctgccattgcaagagagctgaatatccgcaagcagacctctgcccgtgtgcatttggcggcggggctccctcttacttgggtcagcgaacagaaggatagcttcaaggcgtacctgttgcagaatgaaatggcggatttcattttccgtggtgtcagctatcatgtggagtttgccggagcggacatcttcccgcagggcttctccgctgtggcggacagactgcggggattcaagggcatcaatatgctttgcgacattggcaacggaacgatgaatgtcatgtatatcaacgagcgccgtccgctatctcagaagtgcttcacggagaagtacgggacaaaccagtgcatgattgctgtccgggaaaatctcatgcggcagtttggcgcatcggtagatgatacgattctggagcgtgtgattcgctttgggacggcagacatcagcgaacgctacctaactgctatccagaacacagcgagggattacaccgcaggcatcttccgcagactgcgtgagcatgagtatgacccggaactgatgaggctctatgttgtcggcggtggaagctgcatggtgaagaatttcggagaatatgatgccagccgggtgatgatcaatgatgacatctgcgccacagccaagggctatgagctgctgtctgcacagaaaatgcaaaagaaaggcgatcttgtatgaagcaaatctacacaacaacacttcggctgaatctggagaacgaagcagaccgcagggcgtgggagcatttgcagagccttgacaggcgagaatatcgttcagtcagcaaggcagtcgtttcggcggtcaacgcttactttgaccgtagcaagcagcttgccgatgatccctatctggaaacacgggagaaggaggacgctttcctcagccggatcgaggataccatctcacgcagcttgcagagctgtacgccggtaagccttggcggtatcctacagcttatgcagagcgcacagcctgccgctgctcttgtttcggaggaaaccgaggaggacatttcagctgcgctggattttgcagacggcttttgaaattacttttcttgattttactactatgttggtggcaatacaatccgtctttgctaccaaattggcaattctcagaatgaggaaaacaatttaccatcagttctgcagggagttggtatctgtgtgataccagttccctgctttttactatcacgaagccgcccagcggcagaaaggagccagatatggcaaataaaaagatcatgaccaaggaagaattgcaggccaagcaccgattggaggaggcacaaatgcgggatcgggcgaaagagcgaaaggcccgtaccagacgcttgattcaggagggcgctgttttggagaaagtatttccagaggctcagcaaatggagcttgaaaaattagaggacttgttatatgagaagctacactaatctgcgaggggcgttccgggcaaccggggcgtcccttccttttttatcccgaagggcgcacttactcaccacctgcgaagcaggcggtggtatcccttccgttggtcgggctcgtgcgctcttcacgaactgtccatcggacacttctccagagagggcaggaaatgccgcaagtcagcattccctgtgcagtcggcgcttctgctgatgcagagattgctgcttgtcgcaccaatccggcagatactctgcccgcctcctgcctgcgaaaacctgccaccggcagctttatcgcagatatgggcagcaatgcagcccattttctctttgcaaagagaaacagaaaccaaggggtggcgttttaccaccccctcacaaaatacgaatcgaggtgaacgcaaatggcaatttaccacttggaggcaaaggtggtcagccggggagccggacgctccgcctgtgcagcctccgcttatctcagctgctcccacatcctcaatgactatgacggagtacagcacgattacacccgaaagcaggggcttgtgtggcaggaggtattcctgccggacatggccccacccgcatggcaagaccgagaggttctctggaacgccgtggaggaaaacgagaaaaccaaggacagccgcttagcccgtgagtttgtggtagccctgcccatagagttgtccctagagcaatggcagacgctgttgacggacttcgtacaaaaccaatttgtcgcagacgggatgtgcgccgatctggcaatccacgatcctgatccaccgggtcataatccacatgcccacattctcttgacggtgcgcccgcttgatgaaagcggcaaatggcaatacaaaacggagaaggaatatctctgcagccgtgacggtgaggaacggggctttaccgctgccgagtttaaggctgcacaggctgacggatgggagaaacagtaccagtacaaggtaggcaggaagaaagtgtatatgacaccatccgcagctgaggaacatggatatgagcgtgccagcaagtatcccaaaagcaccaaatacgggagacagaatcccatttctgaacgctggaacagcgaggaacagctccttatctggcgcaaagcatgggcagatgtgacaaacaaatatttggagcgatacggtcatgaggagcgcatcgaccaccgcagctttgtcgagcgaggcattgacgagcagcccaccatccacgagggcgtgattgcccgtgctttggaacagaaaggtatcgtgtccgacaggtgcgaactcaaccgtcagatcaaggcggacaacaggctcctgcgggaactgaaggcgcagttcaagaaaattacggaggcggtgaagaacacgctgcccgctattgcagaagcgttggaaaagctgcgggaaaatatgctgatcttctgctatcagttagggcatatccgcagcagcaagaaacagatgaccggtgccttgaatattctgaagccaaatctggcacagtaccgctcccttgtgcagcagataaaggaaacaaccaaagaacggaagtccctactggctgaaaagaaatcccttcctgcgatccactttgtcaggcaccgtgagcttgcctccaaaatagccgagttgacggaaaagttagaggagctaaaaagcgaaaaggctatgctgcttcattctctggaatacccagaggacgccacaagcgatatcttccagcgccagattgaccgctatgaagataatctcaaacggcttgaggcgcaggagaataagtatgccggagagctggaggctgcattgtctgagtatgccgagctgaaagagcaagcttccggctttgattccttgcagctttatctggagcggaaggcacttcgacctgacagagagaaagcagcagcccaacgcattgaagcggcttatggcgacaagttcagttggtggttgatggagagtggcctacgggatgtgtctggctatcttgacgaatatgcacaggaaaagacaatggatcgagaactgcggcaaaggcggcgatcggagcggcttgagcgtaagatgaaaaacagagatatggaacgttaaaagtgctggaggttgaaacttcaggtgaagtctgtgacatagggggatggagataatccctatacgtcaagcgtaaaataagcaccggtatgggttttccataccggtgcttgcaatatttaatcgaattctatcacttaaaatcaaaagagttttccaacaacttatcaagtgctgccatcagttccgctcgaacagcctctctttcactttctccgcctgcattttcgatatagatggaatagttatcaaatgtgatataggcgtaatagatcacagtcttaattccttcgctgtttgcatttgtaacgaagtagccagctttaactggcgtatctccaaccatagatacatttcccttgccaattacggtagtatccataagattgttcccagacagcgaaacaacaaatttcatatcgctgtaatgaccatcaaagccaacaaatgctacatcgtccaaggtaaagagggcatctccggaaatcggaagatcaccgaaaatagtctgaacctcatctttggtcaatgctcgtgcttgcaagttcaaactcagagcagaggctaccgtatctgctttagtgaaagatatggtagttccatcacctaatgtagctgtttctgtacttttgccgaataatcccatactaaacactcccaccacgattagacagagacacgcagcaattgccccaaatttcagccaaatgcttttttgtttctttgcctgataactcgccgtttcttcgatatgacggctaccaatgccaccaacggcgtcagagatgttctttcgtgtcataaatcataccccgctttctgtaaatgatttttaagtttgcttctgattcgggaaaggcgaacagacacattgttatttgttgtacgaagcctctttgcaatttctgtaatgctatctgagtaccaataccttgctacaaacataaccctgctttcctgatccaagctgtcaaggaaacgatcaatttcctgtgacagctcctttgcatccacttcctgttcaatagtagatgcagaagttaggcactcttccaactcatcaagtgcaacatcatagtaactgtttcgctttagtgcagtatttgcgtggtattttgcggtagcgatattgcgggtaatacgaaaaatataggttctgagtgggtcaggtctttctggaggaattgcattccacgcagcaaggtatgtatcatttacacattcttctgcgtcgggttcgcatttcaaaatgttgtttgcaattcttttgcaagttgaaccgtattttgcagcaagttcagctattgcctgctcagtacgagcaaagaacagttcaatgatcttcacatcctctaacaaggtatccacctcctcacctatgtactatggatctggcggacaatcttacagaagcgagggaaaatttcacacctttattatagtacattgcaattctattttctatcgcctcagcaaaatcgtttggcaccagtcgaggtcgctcggcagtctgaaaatatggtccttcggttttggtagagttgctcgcagcagaggaggcgtaacaaaaaattaaaggtagctgcccggacagaatgggttgggtggaaaaataaataatatccgaaacaggatgacggaaattgttagcgccgagttaattcgtacacagttagtgtttaagtgtttacaaacagcccattgatattgttcgtttgtgcgtatataatatatataactatttgatgcggaggtaaactatgtttgaatacatgacagtacaggatgcggctaaactttggggaatatcggtgcgtcgtgttcaaaagctgtgtgaggagaatcgcattgatggaattgttcggctacctcgtgcatggctaattccccaagatgcccaaaagccggctgatggaagatataaacaaaataaaaatgaatttatagctgacaacaaggagaacacacgatgagtaaattgttattagtggaggatgaccaaagtatcgtatcctcattatcagactatttaggaaatgaagggttcaaaatcgaaaatgctcccggtcaaaaagaagcaatagaaaaattggatagcgaccaatacgatatagccttggtggacattcaattatcaaacggaaatggtttttctgtttgttctgcaattaaagaaagaggaactatgccagttattttcttaacggcttctgatgatgaatatagtgttgtggctgggttagatatgggggctgacgattatatcagcaaaccgttcagaccaagagaactgctttcaaggatcaacagcgtattaaggagaactaagaacacacaaaacattatcagttacctcgacttagttgtggacacaaatcaagcaaccgtatcaaagaatgggaaagagattttgttgtctgctatggaatataagttgctgttagtctttttgcgtaacaaaggtattgtcctttctcgcagaagattgttggagcttttatgggacactactggggagtttatcaatgataatacattgactgtctatatgaaaaggctacgtgacaaaattgaaaccaatccgcaggagccggaaatcataattaccgttcgtgggcttggctataaggtgggttgatatggactttatcagaaataaagaagttaaaaggcaaattgttgtcagcagtattcttattctattttggggcggcattggcattatcgttgatagcaaagctgtgtggattgttctgtcggctatcatttcatccagtgcagtttccctctttttcacatatcagagatacaagaaaattgctgattttagtttgcatattgataggctgttacatggagatgaaaaaatttcttttgggcagtttcaagaaggtgagttatctgttttacatgatgaaatatccaagatgacaagacggcttattgaacaggcagaagctctgaaaatggagaaaggtaatttggcaaatgctttagccgatatttcacatcaattaaaaacacctttgacatcgctgaatatcttaaatgcttctctgtgtaatgaggaactgactgacgaagaaaggtatgagctgatccgcgaacagactatgctcttatcaagaatggagtggctgatagccacacttctgaaaatatccaagctggatgcaggaacgattactctaaagccacaggcggtatacttaaaagatgtggtagaaaaagcaattcgtcctctggagattgcggcagaattaaaaatgcagacaatcacgcaagtgattccggcagaattaaaactatctcttgatactgattggactgctgaagccttggggaatgtaatcaaaaactgtatcgaacattcaccagagggcagcactatcgaaatcaaggcaatagaaagacctcttttgacacagatcattatagaggatagcggaacaggttttcaggaaaaagacatcccccatttatttgaccgattttatcaaggaagtggctctacaatcggtaatgccggtttggggttggctctggcaaagacgatcattgtcaatcagggtggtgtcatccaagcgaaaaatcgggagtcaggcggtgcaaaatttgaaatctgcttttatcgggggactgcttaatgcagcccctttttaagtgacatttttgtaatgaaaaagtaatgaagcagtcacttggctttgctatactgaattgcaaaaatatatggaggaactttttatggagatattaagagtagagaatatctgcaaaacctatgaaatggacaatgctcctgtccatgctttgtcagatgtttctttttccgtcgataaaggagagtttgttgcaatcattggagcatctgggtctggcaagtctaccctgttgcacattttaggtggtgttgacagaccgacttcgggaaaagtatttgtggatggacaggatgtttatgagcaaaatgaagatgaattggctgtattcagaagaaggcaggttgggcttgtctatcagttttataatctgatcccggttttgactgtcgaggaaaatatcacgctgccgattcgattggatgggcgtaaaatcaatcaggagcgtttgaaagaactgctatccacactcaaactggtaaagcgtagaaagcacctgccaagtcagttatccggcggtcaacaacaaagagtggcaatcggacgagcgttgattaacgcacctgcgattatccttgcggatgagccaacgggaaatctggacacggagaacacaagggatattatgaaacttctgcgtgaatccaatgaagtctatcgccagacaatgatcctgattacccatgaccgtgaaatcgcaatgcaggcagaccgtattctggaaattcaggatggcagacttgtgagggatgaggtgatacgctgatgaatatgattttcatgcttacactcaggaatctgttgtcgaataaaaagcgtaccctactcacacttttaaccattcttttgtcaatcagtatgataaccgctattctctgtgggggatggtcgttggttgattttttgaaagagaaagaaaaagtgtatggtggcgattatgactactacatggaggatttgacttgggagcaggttcaagagctatatagtcaaaacaatgtaggcgaagtttcgcttctccgctttgccggaaacagtttttacggggagaaatccaacagtacaatgctctccgttggcgagattgacgagaactttacccaaagattttcgttaaatcagtatttgcttgcagggcgtttcccgcaagatgaaaatgagattgttatttcagaatcttttttgaagaaaaacaacatgaatacagagattggagatacgatttctttaactcttggttcaagaatttgggatgaatataatgcccagctttccgggctgacaaattataggggcgaagaagaaagcttcgttccaacaaaagagaaagcgtatgtagttgttggtattctgtcagatgtgaatgactcaaaaatcgcagcaaactataatgcctttgcaggtgttgacaaaacggcatccgattttgctgcgtatgtcaaggcaaagaatttatccaattcgatctatacagaagccgaagaagtggctgcggcagtagacagtcatgtagcaaagtttcattcggaattgttagtctatcatggaattaccgggggtaaaggagctgcaaaactgattgctttggtggtcatggtcgtttgtcttttgatggctgcatctgcttcaatgatcagcaacgccctctccatttccttacaggaacgaattaagcagatgggaatgctatccagtattggagccacaaaagggcaaaaacgccttagcgtatatttagaagccttccttttgggagtggtgagcataccctttggattggttgttggtatcctgctatctgctctgttattaagtgtggtcagggcagcttttggagaaacattcacttttggcatcgtagaactgtccttgaaggtaaacggattgatcctgctcgtcagcggattatccggcattgcttctttgtacttcggaagtagaaagcctgtgaagcaagcagctaaaattacagttattgaagcgatccgccagtctaacaatgcggtatcaagaaagaaattccgtgacggaaaaatcgtttctttggtttttggcatttatggttcgttagcagcaaaaaatattaagcgtaatccaaaacgcttccgagcgattaccggctctattttcttgtcggtggtaattgccctttccttatatagtttctctgattttatgctttatcagacatccttggatatgaaggaggacggttcctgttatactgatgtgatttcgatgattcaatacaaagatattcctgtcgcaatcggggcattatcggatgaaaatatcactgcggatgtttcctattcttttcagcgatatatgaccgctgaattttcgcaggaacaaatcaatcctgatatgcaaggatattttatcaatggtacgaaagcagaggtatatgtcgtaggattggacgaagaacattttgtctctttttgcgatgaaaatggattcagtctggatgtgacaaatttcaatcatggaattttgctcaatcagactatgggatactataattcggcacaaaatcgggtaattgcaggctcaccgtttcttattgaaccgggaacagaaatcattccgctgggggcatccgaggatgccttgccgattatcgtggaagaaatcgtttcagaagaaaatgcaaatatccaatccatgtttgtgagagatcgagctgtcctcatcgtgcctttaagttattttaacttgctgatagatgataacgcctatgtggaaatgagaatacagacagcacagcataaagaagcaatggaatgtctggctgacagaggatttccgcaaactgtggacattgcagccgcaacgaataattccagacaggtatatacgattgcaaaactggtaatctgcctgttctcgatcctgatgacggttattatcagcttgaatgtttgtaacactatctcgaatacgattcatttgagaagaagcgaatttgctgttctgcgttctgttggtatgactgccaaaggattaaaatgtacgctattgctcgaagctgttttgtacggcgtaaaagcattggttcttgcgttgcctgtgagctttttgattcattgtgctatctactacttcatatcgtcgggtatgacaccatttgctttttatatgaacggcggtatttatgctcttgcagttatggctgtcggcgctatggtatgtatcgctatgctgtttgctgttagaagcgtatcaaaggtggaaattgtagaggaactgaaattgagcaatatgtaatcattcaatctaacaaagcaactgaaacagaggtaatagaaattgcgtaaaaagaaactggtaaagagagttgcaggcattgctttgactgttggtgcagttatacttgccattgtatgtgttggtaaagtaaatcgcattcagaacgaaaaagatattattggcacatggaaggatgcaaatgctgaggagatatttacctttcaagaaaacggggaacttgctgtgagtaaagatatgcccgattcgggtctatcctgcggtgacgcatattatagtttttcttactcggatataatctgtgttacacagggaaatagtagtgtagaatttgagatagaagtagatcaaaacgaattgaaaatcttcttcatgggacaagaatatctggaattggaaaagtaatgattacaaataaaagaaaaccattgagccgataattcgcatcctctgcggactaacggctctgcatatattttgaacgctattttcagaaacattgtgttttgcagaaaagccccttgacaaattccatctcaaaagcaaatgcttgaagattatgctatgaaacatggttttacgaatcttgttcattttaccgatgatggttggagtggagcgacctttgacagaccttcatggaacagacttgttgaaggtgttaaaaacggagaaatcactgcctgtatctgcaaagatatgtccagaatcggcagagaccatttgcaagtaggttttttcactgacattctgtttagagaaaaggaagttcgatttatagcaatcaataatggtattgacagtgaccgtcaagaaaccagtgagtttgccccttttctgaatatcatgaatgagtggtttgtcagggacacaagtaagaaaattaaagctgtactgaaatccagaggttcttccggcaacgctcatacaagtaatatcccaccatacggctatttgaaagaccccgaaaaccccgaccattggattattgatgaagaagctgctgaagtagtccgcagaatttatcgcatgactattgagggaaaaggaccttatcagatagcaagagaactttcagaagaaaaaattgaaagaccatcttattatcttggcaaaaagggacttggaaatcatgcaagcaactatgacaaagaaaatccgtatatgtggcgaggaaatcaggttactactctgattgcccgaccagagtatatcggaaagactgtcaacttcaggacattcaaaaattcctataaggacaaaaagacgaaaagggcagataaggaagattgggtggtttttgatgatacacaagagcctattgtcgatgaagaaacatggctgcttgctcaaaagttaagacagaatgtaagaaaagcagatcctatgggcgagcctaatgttctgaccggaaagatttactgtgctgattgtggtgcgccgatgtataatcacaggcagcggaaagggcgagaaagaatatactatactgccaaaggcgaaaaaaggacaagttattccaatccggcagattgttatgaatgttccacatataatcttgcttatcagaagtatgaccgacattgtacttgccaccatatttcaacaaaagcacttaaaagcatcattctgaaaaccatacaggagacttgccattatgtttctttgaatgagcgggagtttgtttattctctgcaagaagaatcggcgatgaaagatattgctgtttctgaaactgtaaaaaaccgcattgaaagaaatcagaagcgagttcacgaactggatatgcttatcaggaaaatctatgaagataatgtgattggaagattgccggacagactttttcagagtatgcttactgattatgaaaatgagcagaacgagctgaacaagattattgagactgacaccgctgatatgcaacggattataggcggtcaaaataatgtggagcgttttctaaagctggttaaaaagtatgagaatattacagaacttactcctgccatgataaatgaatttatcgacaaaattctggttcacgagccacaaggaaaaggtgcagaccgcaccacagaggtggagatatatcttaactatgtcgggcaatttcaagtacctgtggagcagcatgaaccaacagaggaagaaaggattgctgctgaaaaagaggcggaacgacttcgcagaaaacgagaatccaatcgtaagtatatgaaaaagattcgtgagaaatcaaaagaatttgcggagcatgagcgtatagcagaagaaaaaagttctgatagcaatgtgtgtgttgaacagaacgtcacaagcaaatcaaatcggcaaaaagtgaaaggagaaaaaatagcatgacagaattgaaatcacgaatccatgacaaaagcaacggtctggactatgttcttgtgggcgattactatgtgccggacttgaagctaccggaggaacaccgccctatcggtatgtggggcagactgcacaggacatatttggagcagtaccgccctacaaggttctctgccctctgtttatccggcgaactgcatacttaccttgctgacctggacgaacaggcaacggaaaggtgcagccttatcattgagcagatgaaacaagccgagggcgtgaccgaaaccatgaaagcagacaatcagatgttgtgggtacagtccatgaactctatccgtaaccgagccgaagaaatcatcagacaggaaatgatttactgctgattttatcaagtccaaaaccaacaaatttgtatcgtaaacgaagcgacaggtatttccttatgaagtgtctgtcgcttttcatttatcaaactttaaggaggaaaacacaatgaagatgaaccggaatgaaatggaagccctttatgcctttggctgtccgaacctgaaagcaactgtcgagcgtttgcgtatggtagctgcccttgcacccgatccagtggcgaagaagctgttttatatgctttccgtcaagctgagtgctgagggtgttgaaaggtggtatcgctgcttttactgcaagctgcgtgtgttgaaaaaccatagggagggctgctatgacgagactgacgaagattgagaaagaaacaatcgttctctttaatgagggcgaggacaaggcaaatatctacacccacaacgccggattgaaaaagaggttggctgcttttgctaagaagtaccctgacctttgccgactggaaaaatccaatgttcaaggcggtgtttcttatgagctggcaaagtcccgtctgtctatccgtttcctgccgccttacagtgaggaacgcagacagaaagccagcgaatatgcgaaaaagcatgggctgaacagccagcagggataatgtgataatcagggctgatatgcggttaaaatgtcaggtgcagacctgatgttttgaccgttgcctatcgcctgtgaggaaagtatcggggactatggattttgcggaaatgtgcgttacaaggcttgaacaggaactctgtacacaaaattttttcttccattctttaagttgatgaagtataatgagatatgaaaaattgaggtttttaatactcgatttcaaacaatcatttttatatagctggaactatggagggcaaaaatgaataattttttacgaatgtgtttgaatataattacacaaataggtccctatttagttgtacttcttcttttgaaatatcttgtaaatcttcaacaaaagagagctaaagaacgagaggaagaacagaaaaagggaataattaggacgcattatataataaaaaccgaaaaagtacttactatgttttttgtattggcggtgtttctttttgggggagctacggtagccagtgctattcaacaagatgatttattgccaccaattggttttagtattttctttattgtttctttaatcggctcattgaacatgattatgtggaaactggaagtgaacggagatgaaatcacatggcgttcaacttttggaagaaagagaacttttcactttgaagatattacctattgcgagagaaagaaaggttctatgcgtgtatatgtaaatggagaaaaattatttaccattgatagtaatattgacaaagaagaatttatggaggacataaaaagaagaagaatccctgtaaaatcttactgggcaaatcagcataagaaaaatcgtaaatgacatagattttataacagtacgatgttagacaactgaatatgaccgtcaaggtcagatgaagaaaccgatgtattgagcgtaaagcgatcatgcgtcggtttttcttatttcatgagctgacagaattccgactgtatatcacccgtgaggaaagtatcggggactatggattttgcagaaatgtgcgttacaggtaagtaaaaaaactacttgatagagtgtaaattgaattgttcatatcggtatgatataatttactgaaatgaagcaagaaggtggacttttgtatgaaaaaatttttgaaaatattgctaatcgttataggaatagtttttttgatttttgcagcgctgatatgtattggactgtttgttgattatgatgaccatattgaaaatggtcgttatacttatgttccggaagaagaaaacaaaggaaatgagtatatcgagtttaagttgacagataatggaaaagacgattctaaacttacatattataattctatcgaagaagctattttgaattcccccttaaaagcagaacatgaagatttatcagctccagaagattttcttaatcatgttgatgaaatattgcatatatggaatggcaaacagtatgatacgattttctatcgagcaggaagtgataacgatcccgttcaaggttttgtgattgcacgctgcaaaaaacagatagaaaatgaaagtacacaatatgcgtttgtaaatgccacaccatctgccactacaccagataccacttatgggggagacttcaaaaaatttatccatttatctttaacaataagtgatattcaacaagacttaaatccaaattatccagataccagattcgtttttggctatgcacatgataaagaaatttactcattagaagtagagggtcaaaagccagatggaattatagaatatgaagaatatggtagaacgatgtatatgtggtattataacgatttggaaagcaataaaagaggcgattgtctgagctactcagtagatgtgccagaataatttttcaaattggctaatctgccacaactgaatatgaccgttaaggtcagatgaagaaaccgatgtattgagcgtaaagcgatcatgcgtcggtttttctttttgcaaaatagtccggtggactgttttgcaaaaccgaaggaactgacagagcttgagacggggcgaagtcagtttgttcgggcgggagtacagagggtgcaaccctttgtgcatgggtacagggaatgcaatacccctgtgcaggtcaagggcggcagccttgcccagttaagtggcgtttcgccacttagtactgggtattacttgacgcagaaagccgcaaggaatcagcttcgctgcccttctcccctgtcggggaaatcaaaaagaaaaggaggaactcatgtgaaattaacaaggcacaatggacgagctggaaagaatggcgtttataatccgaagcacaatgaccgcagttttgacattgccaacagcgaacacattgacgaagaacgagccaaacaaaatctctattgggactgttacaatggcttccgcaatttcaaaaatcccgataaggaaaatgagctgtctgccacttttgaagatgtggaacagcttttttatcgtcagcggtatcgtgattttgtaaccggacaaaacgaaagaaatgtgaagaaccgacaccctgaaaggaataaggaaaccggtgatttactcaaaagcaaaaagacctgtccagaggaaacggtctatcagattggaacacttgataatcatgttccaccggaactgctcattgagattgtcacagaatttatggaaatcgtaaatgagcgtttcggctctcatgtccatatcctgaattgggcgctgcacttggatgaaagcacccctcatattcacgagcgtcatgtgttcgactgtgaaaatcaatatggagagattgccccacaacaggaaaaggctttggaagcattggggtttgaactgccggaaccggagaagccagtcggaagaaaaaacaaccgcaagatgactttcgattcagcttgccgagtgctgctgtttgatgtggcgaaaaagcatggcttacaactggaagaagaaccggaatatggtggtcgtgcatatctggaaaaacaggactatattcttttcaagcaaaaggagcaactggcagcacaggagcaaaagttggaagaactcacgatgaagattgaagatgtggaagctttggtggacgaggttgccgatattgcctatgacaaggcggttgaggtcgttgctgatactgtaaaactggaaacgcacaaggaggatattaagctggtggagcagtctaaggcgtgggttctctcccctgagcgtaaggcttcaaagaaagaagttgagtatgcagtgaaacgattggatggcgtgattgccagaatcacaaatgctatgaaatcaactattcagaaaatccaaactacgctgatgaaaccggaggtcaaaaaagccggaacggagcaaatcaagaagaaagccaaaagttccattatagagcagttgagccgcaagaagaaggaaatggcagagcgtgaagtcagccggacaattccggcgaaaagcaaaaaacaggatatggaactttaaggcacttgctattttcgttttgaaaatgacaggtgcttttgctttagggagcaggaaaatatcttccattctttaggttgatgaagtataatgatagtaagaaattttttgcgttagaagctatttctgcatttccggattttgttacgaatacattaattcctattactaaatcaaggctaaaagataaagagaaaccattagaaaaaacagaaatctcttatgttacagaatatttacaaaagctttcggagttactaagagaggaaaaattaaatgaaatgatagagtgtccgataatgtagaaggaggaattctcatggaaataattttactttgcttgtatggaaaagttacagttatagttatctttttaataatatacctatattggatatggaagaaggttagacttataaaatgggagcaggcacctggtgacaccagagattggatacgaaatcacgaaaaaaatattaataaaattattaaaattatttctgggataggtttgatatttatggtttattgcatagttattcctgctatattagatattccgacgttagtcaagcaagagtatacagttacagaaggaatagtagagtcttggaattatagtgatgaggaaaggctagaagagcgaagtatatcaataaaggatgatactggacaggaaaaatctgtaatagtatatagtacaggtattcatcaaggagaacacttagtagttgagtatctccctcattcaaaatatggaatagtaaaggagcggataagatgaaatggtttaaacacttagttttcttggtgttttttgtaatgtttgagtttgatacactaaataaagtggtaatatatacttggtaagaggagagatttttatgaaaaaggttataacgataattagttgttgtattataatttttagtataggaggatgtatgaatagagagaaatatatgtctgattggtttacatcagaacaagaggaagcagataaaatgatggagcaaataatagaagcatgtagaaaacaggatacgcagaaactgaaagactattttcagaaaatagtagaaaaaatatcaaaaatattgatgtgaaaatcaatgaattgtttcagtatttaaaaggagatatacaaacatttgaaggagattgtgcctcttcaagtgacagtgatcacggaaaaaaaataattgaacttgacggaatgtataatatatctacatcaagcgaaaagtatcacatgaatttctatatgtatagtcaaaatgatagtgatagtaaggcagtaggtttgtataaaattgaaattgcattggagagcgaagtggctgaggataattttatatgggataatcccccaaacggtatttttgttggaggacaaaattgatttttgttatgagagaacattaaagtataaatttcggatggtataagaaaaactgactacaattaaatcttcacagctttactaagcaggagatccgaaaaggtctcctgcttttttgcaccccaaattgaatatggaactctaaagcacttgctgttttcactttgaaaatgacaggtgcttttgctttagggagcaggaaaacatcttccattctttaggttggtagagtataatgtaagcaacaaatatgaagttgtggaggtgatatgatatgaaatatataggtggcattataacgtcatatattgtcttattagtcttagatataatgcaaagaagaaatcataagcgaacacaatcgttaaaaaaatttacggtaaggacaataactgatgtaagtatagtttgtgctgttggggctatttttgtgattggcgcaatggtatttgcactaatagacgaacctgaagtatttaagaaaaatacctttattatgcttatacttgttgcttttttaggattgatgttttttggtatgattgcaccaataaaaggtgtctgggatatttgtgtagatgaaaatgatgtgactgtaattaaggcatttttttataaaaggcattggaaaatatcagacatatcctattgtaaaaggaaacgtggtggtatgaatgtgtatgtcaatggaagaaagaaaaaagctttttttgttgatggtatgacagaccactttgataactttataaagcgaatggaaaaagagggaaaagagattattcttccagaaacaaaagaaaagagataggtttatagataagcagattccagtttgcataactggtagcctaaccacaattaaatcttcaaagctttactaagcaggaaatctgaaaaggtctcctgcttttttgcacctaaaattaaatatggaactttaaggcacttgctattttcgttttgaaaatgacaggtgcttttttcgtttctggaaaggagtcacatgaatgtatttgaagttgtaaaagaaaatgttactgcccgacaagccgcagaagcctatggcttgaaagtgggtcgcactggtatggcgtgctgtccgtttcactcggataagtcccccagtatgaagctggatgaacgctattactgttttggctgcggagcaactggagacgctgttgatctgacagcgaagctattcggtatcgggctgagggaagctgctgtcaaacttgctgaagattttggtcttaactatgacagccgacaaaagcccagtattcgccctcgtattcgtgagccgacaccggaacagaagtatcaaaaagaagaaaatcattgctacaaggtgctgacggattattttcatcttcttagagaatgggaaaagaaatacgctcctaaacagccggatgaggaatggaatcccctgtttgcagaagcactgtataagaagaactatatcgaatatctacttgatattcttctgtatggttcattggaggaacgaaaagcacttgtggcagaacagagaaaggaggtgttaaaacttgaacagcgaattgcagaactgtcagcagacagaaccatgcacagtagaagaaatccgaaacagcttagagcagagcgagaaaggtaaggtttataatactgccgcaaattataagcgtgttctgcaatatgacccacttttgaaaggggctatccgaaaaaatcttctgaccgaaagaatcgacattgtgaagcccctcggttggtatcgtgacagcccgacattgacggatgtggatgtgaaatatctgctcctatattttgaagaaaactatggattgaccgtagagaagaaaatcatagacgcagttgcggttattgccaatgaaaatcgttaccaccctgtctgtgattttctcaatgccttgcaatgggacggaacagaacgcatacgcttctgtctgcaccgctttctcggttctgatacagatgattacacctatgaagcattgaagttgtttctgctgggtgctatctcacgagcctttaagccggggtgtaaatttgaggtaatgctctgtcttgtaggcggtcagggagccggaaagtcctctttcttccgtttgcttgcggtcaatgatgattggttctctgatgacttgaaaaagctggatgatgaaaatgtgtaccgcaaaatgcaggggcattggattattgaaatgtcggaaatgattgcaaccgccaacgctaagagcattgaagaaatcaagtcctttctgagccgacaaaaggaaacctataagataccctatgaaacacatccggcagacagaaaacgacaatgtgtgtttggaggttcttctaatacccttgactttcttccccttgaccgaacaggcaaccgccgcttcgttccggttatggtctatcctgaaagggctgaggttcatattttggaggatgaacaggcttccagagagtatatcaatcagatgtgggcagaagctatggagatttacagaagcggcaatttccgtctgagattcagtccggctatgaacgcttatctgaaagcccaccaaaaggactttatgccggaggacacaaaggcaggacagattttagactatttggaacgctattccggcagcatagtctgctctaagcagctttacaaggaagcactggggcatgattatgacgaaccgaaacaatgggagctgcgagagatcaacgacattatgaataacgctgtcacaggctggagggcgttcagcaatccgaggtattttccagagccttaccgccgacaaaagggctgggagcgtatcaggaatgacaacgagcctgacaacagcatggatggttttcaagaaatcccgacagaggaaatggaacagttaggacttccggaagaatggttgaagcaaaaataaaagcccgttgtcgcttcggttgtcgagccggttgtcggtctggttgtcgggcaaaaatcccgaaagccttgatattgcggcacttttccctctctgacaaccatgacaaccaatattataaagaaaaaggaaatagtaaaaagatagtatcgcccgataaagaaaaaaggttttctgatgtccgttgtcggaacttcgttgtcagacctttccttgtcgggcttttttcatttaagtaggaggaatatcgtatgacaaatattgtgaacagtacactacccaccccaaataaccattcggagaaaaacaaaccggatggagtttttgtgattaagcaaggcaaaacaaattataaagtcaaagtgttttttgaccatagtagcggtttgactgctgaggacaggttgaaacgcattattcaggcagaagcagagagagaatctgcgtaagtaatatgaaaaatatccacgcacccccttgacaaaagctttcagaggacacgctgctctcagcaatggaacacgccagtgcagaggagtttgctgagatcgagggtgtagagcgcaccgggctgggtacacctgcgacccgcgccggtgttctggaaaagttggtgaagggcggtttcctggagcgaaagggccgtcagcttctccctacgaaaaagggtcacaacctcgttgtgatcctaccggatagcatcaagtccgcaaagctgacagcagaatgggagtctgcactgaaagaagtcgagcacggtactctatccccggaggaatttctggctggcattcaaaagcaggtgtccgagctggtggcgtgctataagaatgtgcaggtggaaaccgaactgtttgatgagcgcgagagcattggcgcgtgtccccgatgcggcgagagcgtcatggagcgaaagctgagcttccagtgtacccggcagggctgcggcttcaccatgtggaaaaatgaccgattcttcaaggataagcataaggaactgacgaaatctgcggcgacggcgttgctgaaaaaggggcgcgtaaagatgtccggtctgttcagcgaaaagaaaggcacgacctacgatgccattgtcgttctggcggatacagggcggtatgtgaattatgtgctggaatttgagaagaaggtagcatctaagaaaacagactaaatcctcaaatgcggagaaaggaaaaatgctcgtaattagaccgattcatttagctcaagcaaaaatatttgttaaaaaatatcacaggcacaatattccacctgttggcgggaagtttgcgatagcctgctggaacaatgatgaattgtgtggcgttgcgatttgcggtagacctgtttcgcggtatagcgatgatggcgatacattagaaatttaccgaaattgcacagatggaacgcacaatgcctgctctaagctatatggtgcttgccagcgtatagcgagggatatgggatataggaagattatcacttatacgctggcatccgaaaacggagcaagcctcaaggctgcgaacttccgaaactgcggtgcggctggaggtaaagaatggacaggcagcaggaaaaggaactattatatcgcgccgcatgagatgaaaacaaagtggctctatttgacgaagccttagaaattagaaaggaacaacgatgaacgaaaatacgaaacgattagaacccgtcccgttcgacacctttgccgaacatcttggtcccaagcacgaaactgtcaaggataccgagtacattttgagcgacggcacgatgctgacctccatgccggatattccgtggctgtatcagtccgcggagcatcttgtgaccggcgaagctgccatcccgaaggtctacgctccggtgtatgccggtgcgtcagacctccagccgtctgcttttgatgagatcggaccgctggcacagctctcccgtattaccgccgaaaccgtcccgatgggcttgcccggattcgggcagcggcaggaatccggcttcgtgctggacagcggctatgtgctgctgaacagcgaacgcaccccggacggcggctacaaagccggcgccggaatggatgggatgtacatgatgacgggtcaggtctttcagccgttacaagacgaaaacggaagaatcgtcgcattcatggcacagacgccggagcgtgaaaagcagatcgtccatcagggatacgccatcatcgatcggatgcaggctggagccgtagagttcgtgctgggcgaaaaccccagagcgccgcagccctatgtcacatggcggcataccatcggggatgcgcccacggacttctattgggggcattacttcggcagctatcccaaagcaaaagcggatctgaaaaaccgggcaaaggagtacatccagatgtacagcgaagaaaagccgacttccgttcgtgcacagcttgcccggatgcagcaggagcagaaacaggcatccccaaaccctgcaagagtgcaggaagaacgataactaccattttgcgggcggtgcggaaatgacgcgctgcccgcagctttgaaaggaggcaacagaatgtcgaaaatacaaacgatctccggcttgtttgcacatacctgtgaacaggtcacacactcgccgcaggcgtggatggacttcctcaccacagcgtcccggttctacaaggcctatgattttgacgatcagctcctcatctatgcccaacgcccaaatgctactgcctgtgcggacatcgggttctggaatgatgaaatgcgccgctgggtcaatgccggaacaacggcgattgccctcatccgcaaaggctacggcggcaagccgtatctgtcctatgtccatgatattgcagatacccacccggtcaaggacggcaaaacgccgtggatctggcagctgcgcccggagcatgaaacgacggtctgtgaaatgctgcgagagaaatttgacggtaatggcgcagacctcggcgctctgctgatggataccggcgaaaagctggcgctggaggtctgtgcagatatgacacaggacctcatttatgaaaaagcggacagttttctggaggagctggacgatctcaacatcgaggtcgcattccgcaatctggttcgcgccagcacccaatacgaactgctgacccgctgcggtgtagaccctgcggactatctggatgaggacgatctgcgaggggtgacggacttcaatactcctgctgtccttgcctaccttggcacagcgaccgcacaggcaagccgtacagcacttctggaggtcggacgcacggtgcgccaagcagaactcgacctgcgaaaaaaagaccttgcaaaaccgccgcaagtcctctataatgaaaacacgaactttaccacattagcgcgtgaaaggagcatggaacatggagaagttgacttacaccgaacagaacggatttctggtgccggacctgacgatggacgagatgccggagcagacgcagttgggacgcttcgggaagctgcgggagaagtacctgatggagcaccgcaagggactgtacagctcgatgctgatgaccggcaagctgtggacgcacctgacggagatcgaccggcaggcatcggagatgctggaccgcatgacagagcagcaggcacagacgatgggcgtgaccgagaagctgaaagcggaaaatcagatggcgtgggtgcagcagatgaacaacatccgccactccgcagaggaaagcgtactgagcgacctgatctacgcttaaccgagatcgacacaccgttttccacaccggcagactacgggcaggtatccctgttccgtaccccggaggaacaaattgaacagatcgcagacagcgcagaggcaccggcccctgcgctttttgctgcccgtctgacggattccatcatagaccgtatcttggcggcgggcggaaatgagcgaaacagcagcctgcggatctatgctcggtatcaggcagcggacagcgccggaaatattgcggcgtttctgaaaaaggaatacggtgtcggcggtcgcggcttcaccgtggacggcgcaccgttttcactgtggttcgatgagaccggtatctgcatcgctgccggaaaggcggcgcgatttgtgccgtctgcggtgcattttacatgggaacaggcagagcagcgcatccgaaagctggtagagcgtggcgcatacctgcccgccgatcaagtcccgtgggcgcggggcaacgagtataaggagctttctcaaaacctttggtacatgatgcaggatacggagaaaggagctcagcccgaggcattgatgccgcagctatttgacctatatcaacaatcgccgtccagctttgcggatgcgaccaagcgtatcttagatacgctgcaaacgccggagggtctgaaaaccattacggaggaagtccgtgcgttttactctgcccatgccgcaaatccgaagctcatgcggtggaagctctatctgccggtgcgtcagcttcggacgctggaggaactggcgcagcctgcaagagtgtttgcgaccgatctgaattttcggccggtcaaggtcagttttatcacgcaggacgaagtagatgcgatgatttccgtgtatccgggcggcacggaataccgtctgtttatatctagttatttcgcactgcatccagatcgaaaagagcggcaggattcgctgaaaaatacttttgggatcagcggtcggggggatatagttcgggatatttggtgtgacggtaaaggtatgcggctggatcggtcggacggagaaaaatacgatacggttctgctccgctgggcgcaggtggaaaagcgcatagcggaactgatcgccgcagaccgcttcctcacagacgatgataagcagcagattcccggctacacgaaaaatgtgttggcacggcgcattgaccgtctgtttgcctgcgccccggcgaccgcagagtgtccttaccagcgaggcgatatttcttccgacaataccccggagatcgtggcaatgctcacggagccgaaagaaaccgagcgcttgcaggcggctatgcagaatgttcttcaaggcatgacgccggaggatcgcggctacgatgcctgcatccgcgcctatgacagcctgactgcctaccgaaacggcacctttgacctatggaagtccgatccggcagtttccgcacaggccaagcaagagaaaacgcagacagccgcacaaaagccgacctctgcactggatgaagctgcccgcaagctgtttcgaggaactgcaccgctggcggacggagatcagctttccttggatatgtccccgcagccgacgccgtccgtagagccgaccgaagaacagccgaagctgcgtaccatcaccatcgatctgaccgcaccgagcaagaaaccggaaaagcagtacgatcttggctatggacatcttggcaacggcatgaccgtctggaacaaagcagagttggccgatggcgattacaagactgtggcacatatccagccggacaggaccgtgactttctacgaggatatgccggacgctgtgcgatcggagatcgaaaagatcgcccgcaccatggaaatgaccgtttccgcaacgcaggatgccccggtgttctccacatcggctcaaccggagccggaaaaggaaacggatggagaaattcctacggagcagggcggagataaaacgataataattcctaataacgagagtggatcagccgcaccatccgaagaaacagcagacgaaccggagttccatatcaacggtgaagcatacctccgcctgaaagcagaatactcgacgcacatgatcggtgtgcaggacggccagcacatcttgttctgcggcgcagatgccacgcagatcgtcaaagattatccccgcaaggtctacgaacaggacatccccggcatgggtaaggtccctgtcaccggctttgccgagagctggcagtctgtgggcagcaagctccagcagcggggacacagcgtcacctttgggcaggagaaagacggagagtatgaggtcattcaaagtctggacatcagcgagtatattcccctgcggatgaagctggaggaagacgggcgtatcttcaccgtggagagcgtggattacagcgccggcgaggtggagctgcgggatgatacctttgtatctcaccggggatttcctatcttccgtaatgagccggtgtcgtatgtgcgggaatgggtggagcagcaaagggatgcagacttgactgctgccgcagagggcaaggagtcgctgaacccggttctcaccggtgaggacgcactgaatgccgcgcttctggaacaggcaaaaggtttgatcctcgacttttggagcgaggaatatcgatccgataaaacggaatttcctccggaaaccgacctgcaccatgtagggctcgcctactccacggcgggagataacgatgagcatgaaatacaggtagaagccgacctcattgactatgccatcaattattacgtagacgacgtgttggtgctacaggagaaatgggacagtctgcaggagctgatccacaacgagcttgaaactctggacttcgatgtattgtattcgacagcggttcatgaggcagacttcccggaggagccggaacagtctgaaaattttcatctgacggacggcgacatcaatgttggcggtcaaaaaagcaagtatcaggacaatgtggcggcaatcagactgctgaaagagctggaaacagagcaacgccaagcgacaccagatgaacagtctatccttgcccgctactccggctggggcggcatcccgcaggcgtttgacgaacagaacgaaaaatgggaaaaggaatattttgagctaaaaactctgctgacaccggaggaatacgccgccgcccgcagttccacgctgaacgcccactacacctcgcctacggtgatccgcgccatgtatgccgcgctggagcacatgggcgtcaagccgaacaccgtgctggaaccggcgatgggcatcggcaatttcttcggtctgctgccggagcagtatcacagcgccaagctgtacggtgtcgaactggacagcgtcacgggtaggatcgcaaagcagctttacccggaggcaaatatcactgtggacggctttgagcgcgtcgaactgccggacaacgcctttgaccttgccatcggcaatgtacccttcggcagctacaagctgtccgagctgcgctataacgaaaacaattttttgatccacgatcacttttttgcaaaatctctggataaagtacatcccggaggcatcgttgccttcatcacatccaaaggcacactggataaaaaggactgcgctgtgcgcgagtatctggcgcagcgagcagacctgctgggcgcgatccgtttacccagcaatgcctttgccaagaacgccaacacagaagtcacctcggacatcatttttcttcaaaaacgggagcagccgccggagcagctgccggactgggtggagctgggtcagaccgcagacggtatcccggtcaaccactattttgagcagcacccggaaatgatcctcggcacgatggtctgggacaagaagatgtacagcaacgatctggaaacccgctgcctgccggtagagggtgccgatttggggagccagcttgcaacagcgattcagcacctcgaccagccggatacacagcttctttccactgacaccgccgaattgccggagattgtgataccgtctgtggaagaaacggaaccggttcgcagttttagttacaccgagcaggacggtgttctgtactacaagaacgcgaccgaactggagccggtcagcgaagccgcgaccacgatggagcgtattcacgggatgatttccattcgggatgttacccgcagcctgatcgacctccagatacgtggcggcaccgatgcagagatccatgaattgcaagcagacctgaacgatgcttatgacaccttcaccgcaaagtacggactgctgtgcagtacggcgaacaagcgagcctttgagcaggattcatcttactgcctgctgcggtctttggaaattattgacgaggacaccggcaagctggaacgcaaggcagatatgttcaccaagcgcaccatcaaccgagagatcgtcattgaccatgtagacacggcaagcgaagcgctggcggtatccattggggagcgtgcctgcgtggatctgccgtttatggcaagtctgctgggacgcgaggataccgagagcatcatcgcagagctgcaaggggtcatctacaaagaccctacggccggagaagatcctcttgtcggttggcagacggcagacgaatatctgtccggcaatgtccgaaagaagctgactgccgcctgtgaagcagcggaacgcgatcctgcctttgccggaaatgtgacggcgctggagaaggcacagcctgtggatctgacagcggcggagatcgatgtgcgcatcggcgcaacgtggattgaaccggaatattacacgcagtttgtacatgagctgctgaaaccctctcattgggcgaaacgggaggtgcgtgtgctgtactccgaagtttccagcgagtggcgcttgaccggaaagacagcagacagcgaaaataactcccttgcctatgtgacctacggaaccaagcgccgcaatgcctacaccatcatcgaggacagcctgaatcttaaggacagccgcgtctatgataccgtgaccgacgccagcggcaaggaaacgcgggagctgaataccaaggaaacgatcctggcacagcagcggcaggacttgattcgggaagcgttcaaaagctggatctggaaggacccggagcgccgggaaacgctgtgccgaaagtacaacgacctctataacgccatccgtccccgcgagtacaacggtgagcatctgcgctttaccggtatgacgccggatattgccctcctgccgcaccagcgaaacgcggtggcgcgtatgctctacggcggaaacagtctgctggcacactgcgtgggtgcaggcaagaccttcgagtgtattgccgccgcaatggaggccaaacggctggggcttgtaaagaaaaaccttgtagtagtgccgaatcacctgaccgaacagtggggcgcggatttcctgcggctgtaccccggtgcaaacattcttgtagcaacgaaaaaggattttgaaccggcaaatcgtaagaccttttgcagccggatcgccaccggcgattatgatgccgttgtgatcggtcacacgcagttcgagaagattccactctcgccggatcggcaaaaggcggtcatccacgatcagatcgaccagatccttgagagcattgacgaggcgaaaagtcagaacggcgagcgttataccatcaagcagttggaacggatgcgaaaaacgctggagacccgtctggaaaagctgaatgaccagagccgtaaggataatgtcatttactttgaggaacttggcgtggataagctctttgtggatgagggacatctgttcaaaaatttgttcctcgccacaaaaatgcggaatgttgccggcattggtcagacggatgcgcagaagtcctcggatatgttcgcaaagtgccgttatcttgatgagatcaccggcggaaagggcgttgtctttgccaccggaaccccggtcagcaattccatgtcggaactctacaccatgatgcggtatctgcaatacgatctgctggaggaaaccggactgctgcatttcgattcttgggcggcgaactttggcgaaaccgtcacttcgatggagctcgccccagagggtacagggtcccggtcccgcacccgatttgcgaaattctttaacctgccggagctgatggcaatgtggcgcgaagcggcggacatccaaacggcagaaatgctgaagctgcccgtgccggagcatgagagcatcacggtcgtgacgaagcccagcgcatatcagcaggacatggtgtctgaattgggcgaacgcgccgaagccatccgccgccgcatggtggaaccaaaagaggataatatgctcaaggtcacatcggacggacgcaagctggcgctggatcagcgccttgtagacccgacactgccggacgacccggagagcaaggtcaatgtgtgcgttcagaatgtgtatcaggtctggcaggacacggcggagcagagcggcgcacagctcatcttctctgacctgtctaccccgaagggggacggctcgttcaatgtgtatgaggacatcaagcaaaagctgatggaaaaaggcatcccacccgaagagatcgcgtttatccacgatgcaaaaactgagaatcagaaagcggaactttttgcaaaggttcgcaagggtcaggtgcgcgttttgctgggttctacggcaaaaatgggcgctggcacgaatgtgcagacacgccttgcggcactccaccatatcgactgcccgtggcggccggctgacatcgagcagcgcgagggacgcatcctgcggcgcggaaattcgttcaaaaaagtcaagctgttcaagtatgtcaccgaaggcacctttgacgcttataactggagcattttggagaacaaacagaagttcatcggtcagctgatgagcagcaagaacccgtcccgtacctgcgaggatgtggacgctgcggcactgagctacgctgaggtcaaggcgcttgcctccggcgatccccgcatcatcgagtacacggaactggacgcacaggtcacaaagctgaaactggtcaaggcaaattttgaaagccagaagtacgctctggaggacaagctgctgaaattcttcccgcagtccattctgcgggagcaggagtttatccaggcgctcaccgaggacagcgcccaccttcaggagcatacgcccatcgagttttccatgcagatcggcggcgtgacctacaccgaacgcaaagccgcaggtcaggcgattctggatgcctgcaccgctatgcaggatgtttccgaaaaacacacgattggcgaatatcgcggttttcccattaccctgtgggcgaatgtgcagacgcaaaaattccagcttacgctccaccacaagctgtcccaagaggtagaattgggtgcggatgctgtgggcaatacgacccgcatcgaccatgtgctggacgagatcccaaagaatctggaaaagcacaagacagcgctggaaaacctgaccgcccagcagcaagaagcacaagaggaggtaaagcgtccctttgcacaggagcaggaattgaccgacaagaccaaccgtctgaatgtgctgcgtctggcgctccacatggatgacggcgagaaaccgcagccggagcacacggaggaaaagccgtctattcgcggaatgctcaaacgcatgggcatggaatctgcggcaacggcagctgcaccgggccgatctcacagtcaggaggcggaacttgcatgaagccggacagcggacgcacgatcccactctacttcaaggtatctcccgaagaaaaggccaggatcgacgagaagatggaacagctcggtatccacaaccgccgtgcctacctgcggaagatggcggtggacggttacgctgtccgagtcgacatggcggactttaaggcgctggtatccctgctgcggatctgctccaacaacctcaatcaggtcgcaaagcgcgtgaacagcaccggcaacctctacgccgaggatgtagcagatttgcaaagccggtacggtgaactgtggaatgcggtcagcacgattctgagcaagatgggaaatctctgaaaaagctttactttaccgctttagtgtggtatattaagggcgtagagcagagattggaggtttggaaagatgaggatcgtattcaagattttattggtcccggtcgtatttgttctgtcgatgctggtttggttctgccgtgcaatgtgctggttctcgtccggtgtcctgagccttgcatcctttgtgttctttgcgctgggcatcttggcgctgtttgaaaaggattatttcaatgtgggtgtaggcatcatcaccgcatggctgctcagtccctttggcctgccgctggctgcggagtggatcattgaccgggtagaaaatgtaaaagacgcgattgcagcgatataaatgtaaaagtgcgataccatatggtatcgcactttttattagtccttataggcattccagtattgtattgtagttttataaatatttggaattatgtttttcgagtgcacaaaatatctatatgctgatgaaaatagagagctgataaagagtgaaacgctgatcatcagcaacagttgattcgcttttgaactttgagcaaaactatccatcgttgcagcgacccataatgcaccaaatgaagcaatggtcatctgggcagaacagcaactttgttggagtccaaacatctgaataaaccattgatcaagatgaagaaaatatgcagataattctaaaaatccgttgataaacaaactgataataagcgaaagaattccaataattaaaatttcgccaataaggctggatgaatctccactgattatcgaattaagaagcgaatcaatcgttgagataaagggtaataatgaaataccacaaagtaagattggataaaaaatcgctacatatagcaaagtgagaagttttttgtaatttcctaaagagtgaaaaattgcttttccaaggtcgatacaggcaataataattgcgatgatgaaaaccaatgtgcgtcttagtaatttaattgtcttatcctccgatggttaaaatatacataatattttgtaatagattggttaaaatgtcaataacaaaaatcaaaccccgacacgccagcgagggaaaaagcatcgcgcagatactcaaagaccgtttggattacaatgaaaatccagacaagacgcgggatggtctgctggtgaaaacctatcagtgcaatgctgataccgcttggaaggaatttaccgtcagtaagcagatatacacctccatcaccggacggacgcgcaagccaaaagaggatgtcatttcctatctgctgatccagtcctttaagcccggagagatcacaccggaggatgctacggagctggggtatcagcttgcgatggagttcaccgagggacagcatcagttcgttgttgcgacccatacggaccggcatcatatccactgtcacatcgagttcaacagcacgacactggactgcacacacaagttcaacaattacaaagacacctaccggacgattcggaaaatcagcgacagactgtgcgtggagcatggtctgtctgtcatttccgaaccaaaggaaaaggggcagcactatgcggaatgggcaaacgagcgcagaggaacaagctggaaggcagcgctcaaaaataccattgaccgcattctcccgaccgtcctcacttttgatgattttctcgctgcgatgcgccgcgagggatacgaagtccggcaggacggcaagtacctgaaattccgcgcagtcggtgccggacaggagcgttacaccagagcgaaaacattgggcgcagactatacggaagaagcgctgcgagagcgtgtcggcaagccactgattcacgcaaaaagccgcaccgggcgaacggctgaccctgcgaaaatcaacctcatcgtggatattcaaagccgtctgcgcgggcgcggtccggggtatgagcgttggctgaaggtccataatttgaaagaagcggcaaagacgctgacctacctcaccgagcacggaatcacggagtacgccgcactggaaaaactggcggcggagcagatcgcaaaacgagatgcggcagtgacaacgatccggcaatatgagcagcgcatggagcgcattgcggatctgcggacgcatatcgtaaattacgccaagacccacgacatctatctgcaatcccgcaaattgcctactgcaaagaaggctgcgtttgcctctgcccatgaggatgaactgatactgcaccgcgcggcgaagcgggcatttgaggaatacggcgagaagaagctgcctgcgatgaaggacttgcaggcacagtacaaggacttgctggagaaaaagcgtgttgcctatgcggaataccgtccgctgaagcagcaggcgcaggaaatggaaaccatcaagaaaaatgtagacagtctgctccagattgacgctgaacagcaggagcgcgaagcggaaaaacgccggatcgagcaatcgcaggcgagataaaaaccatgccgcaggcggtatcatgtgatactgcctgcggcatttctttttgcgccgatcggcgcagggtttgtcggactttggacggcaatcgaaaacatccgtcaggatttttcgggggtttggggcgctccccaacaagcgggaagcggatagcctgacggacagtgagcgaagcgaaattgtccaaaaggatatccctttccattgcttgcaaatccttcgtttcggttctcctcgctgaaaatcagttatcagtttcagattctgcgggttccacaggcggcaattctatgccgaaattgctataccgttccagagaatgtaactctgttttgatgaacgcccacgaactgcgataatcatcgcatacggagaacgaagattccttcataaacagcgtaaatccgtccgggtcatcgccgtacttcaagtcaaattcctcggcgcaccgaatcttttcccagtcggaaagatttgttctcccatgaagaatgtgctccaaattcaaagagaagtagtacatactgtatggaatgcctgcgactttggggcaggcagagagccggtcgatattatcccgtttgcgctgattgcggttaagaatcccagcgcggttcggcgtttgaatttgcgtttccgtgtaataaggggaatcatcgatctccattgaatcatcttcgacaacagcatcatcagggatgaatacaccgtccatatcggtgagatgaacgattcggcaaatatcgctctttctgtagatactgcccataaactccttgacctgttcccaaacggcagccacgattttatccgacgaagtgaaatcgcgggtcagaatatcgccatgaacgacctgaaattttaccgtcgaggaagaaaagatacggttcaaaaccgtagaaaggctggtttcgtcggtcggtccctctacgataaaaagcataactttcttcttagccattggacacctccggggatgcgtcctctgccaaagaaaggctctccatacgcttgccgacaactctcattgcgtgtgcgatttcagacacattggtttcttcatagagtgctgcgtcatcatcacttccgagaatgacttcacgcagatacatggaacgcagattatttgttgcccgcacacttttgatacgcgtatagcgggcgttggggttggtcgttgtaaagacgatggaattgctctccagcgtttccagcggataaagattgtgcgaggtgaagatcaactgacccttaccggagttttgcatgatccgcagcagctcgcccagcaaatactcgtagataccggcatccagttcatcgaccgcaagtgtaatagatggatcgttgtatgcggcgatcagcagatgcaggatcgaggtgatttttttgataccctcggattcatacttcaagggcaaacggtgcatttcaccattggcacagagtagctctcgtgctaactggatttttgttccctgattgccgtcctccatcagctccgtgccgagctccacaagcgtcagctttgcgccggggatgattttgcaaaggacggtgctgatggtcgagataacttgtcgaatgatctccaggaaccgagtcggtattgttttcggctggtcgattggcagtgtgaacataccgccggccgtttccgttcggaagttcacggggatcgctgcatccaacgagatcagtccgttgttgcggttcagaatgacaaagagcgaggtcttggcgtaaagtgccatttcatacagcggctcaacttcatcatcattgtcctgcgctgcgtcatggagtatcttcaaaaactccggagcaaagaggaacgaacggtgctccttctggcatagcagcttggtcacgcgaagctcattcatttttgcgctttgcttagagccgaacagcgattccaatttcacctgcggcgtgaatacatcatcttcctcctgatgtgtacactcaaagatggttttcagccgagaagtcttttcgggatcgctgctgaatgtgacacatttgatggtttcatcaatcgtgtccttgctcaaggcggcggcatagataaaccgccgtctgtacgcagcatttccctcattcagtttgaggatgctgaactcaaattgcagttctgctttctcttgtccgtaggaaatgcagtctgacaattctgcgccgaccttttgcccggacagcagtgttttcaggatttccagcgcatcgataaatgttgttttgccggagccattctgaccgtaaatgccgaggacatcggctttcggtgcaaaaatatcctctccataattgcatggaaaacgaatgtcaccggattcaacatttctaaagtttttgatacttgcccgctggatgcgaacaataggagtttcattcacagataccacctccagattcagtatacccactttttctaaaaatagcaatatgaaactcgaaaagcgaataaaaaattcacatattagaatttaagctgaagtattctggaagtgaaaacacaaaagtgcgttcatattcggaaaactggtttttatgaaggaagcgctgctgccggtttacagtcataccggatttcgctttccctattgacaaggtatgtttctatctgttacacttcacgcaatactcaagattggaggaaaaccacatgaaacaaaaatggcttttgaccggaacagcgctcatgcttgcggcggcgctgaccggatgcggtaatgcgcctgtggcagatcaggcggcgaagatcagcatggaacaggcgcagacagcggcgctggacgccgccaacatcgacgcggcggacgcggatatttcatccgcaacgctcagcgaggtcgctggcgtgacctgctacaaggtggagttcacctctggcgatcatacctatgcgtattccatcaacgccgagaacggcgaggtgatggaggcgagctaccgggataagaacgccgcgcccgcggacagcactcagtcggataccactgcatccggcgcgaccaccactccggcgcagaccacgcccagcacgaacaccaacacctctaccggcgcggtggacgaggccaaggcgcaggagatcgctctggcacacgccggggtcaaggcggcggacgccaccatcaccaagtccaagctggactatgacgatggccgccaggtctatgagatcgagtggtacgcaaacggcgcaaaatatgactatgagatcgacgccgccaccggcgagatcgtcaactccggctacgaggcaaagaccgtggtcggcaccggcaacaacgccaccgtcagcgaggcgacagcaaagcagaccgcccttgcccgcgtatccggcgcaacggaaaaggacatctacgaatggaagctggactacgacgatggccgcccggagtatgagggcaagatcatctacggcggcacggagtacgaattcaccatcgacgctacctctggcgctgtcaccgaatgggatgccgagagcctgaaccgctaaggagggactgaacatgaaaaagagccgactcatccaaacgactgcctgcacgatggcgctgtccgccgcattgacggtgagcgcctttgccgccaccaatgtgaccgcgaccctgcgcccggatgtgaccgtccgcatcgacggcgttgcctgcgacttctacaacgcccagggcaaggaggtccatcccatcctctacaacggcacgacctacattccgctccgcgccgtgggcgaactgatgggcaagaatgtgaactgggacggcaccaccggcaccgcctctctcagcgggacgcgcaccaccggcaatgtggctgggacgccggacacggcggcgaagcgcacggatgtgaccttcaccctgcgcccggagtatcacatcgtcatcgacggcaccgagcgtacctttgtgaacgccaacggcacgaaggtcgatccggcgatctacaacggctccatctatctgcctctccgcgccattggcgagatcatgggcaagagcgtgagctgggacggcgccacccagaccgtccgcttggacagcgcggcctacggcgatgatgtcaccgactttgacaccaacgatccttcccagtccgcgcccaccggcggcgtgacgctggagcaggcgaagcagaccgcgctcaagcacgcgggcaagaccgcttcgcaggtgcagttcgtcaagacgcagcaggactgggagcatggccgtcaggtctacgagatcgagttcatcgtcagcggcggcaccggctataccgagtacgactatgagatcgacgcggccaccggcaagatcgtcagctacgactacgatgccgagaattacactccgacccagaacacgaacaccaacgccaatgtgaagatcagcgaagccacggcgaagcagaccgccctgtcccgcgtccccggcgcgacggctgcgaatatctacaagttcaagctggactttgacgatggccgctgggagtacgaaggcgagatccgctatggcacgatggagtacgacttcaccatcgacgccgcttccggcaatatcatcgaatgggacatgggatccatctacgactgaacaaaaaacgaaccaacggcacacgccctatggacgatttcccgtccatagggcgttttttctttttctccacaaattccgggtaaattcactccgctggagtaaactgttgataccacatccaggaggtatcaacatggacaacatcatcacgaaggaacgcatcgacgcctactgcctgtcccttttggcggacgagcgctcggcggggacgatacagaaataccgccgcgaccttgcggcgtttgcccgctggatcggcggcgcggagatcacgaaagaggctgctgtacactggagatcgcacctgctggagcgtggctgcaagccggaaaccgtcaattccaagctgtcggcgatcaacggctttttcgcctatatgaactgggctatccgcgtgaaattcctgaagatccagcggaagctgttccgcgacccggcgcgggagctgtcccggcaggagtacgaccgtctgctgaccaccgcgcgggagaccgggcaggaacgcctcgccctcatcatggagaccctgtgcgcgacgggtatccgcatcagcgagctgcgctatatcaccgtggaagcggcgaaagacgggcgcgccaccatcgccctgaaaggcaagatccgcaccatcttattgccgaccaagctgtgccgcaagctgagcaaatacgcgaaaaaacaaaaaatcgcttccagcgcgatctttcgcaccaaaagcggaaaaagtattacacggcggcaggtctggtatgaattgaaacggctgtgtcaagcggcgggggtagcgccgggcaaggtgttcccgcataacttccggcacctgttcgccacgaccttttacaaggcctgcaaggacattgcccgcctggccgatgtgctgggacacagcaatatcgaaacgacccgcatctatcttgccgtgagcggcgaggagcagacgaagcagcttgacaagctgggattggtgtcgtaggcgaaatctgcatttcgccggtaaagcaaaaacgccgggaattccgacaattcgcgaaatctgcatttcgttgtttggatgcggcgtacctatatgccgtctgccgaaatttttctaaaaaagcattttccaagcaattaaagtcttgcacaaaggcgcagaaaaccagccccacaaaattcgttactattgtggggctaaaactcatgcctattcgcatggcaggtattgcattttttcgcgttgcatggtacaatttcgatgaaaatatgtagattatcgtcgaggcgattgcggcatcaaagcacgaaatgcagatttcgttgattacagctatgcagaatgacactgaccgtcataactctaacggcgaatatctaacattaaatgcaaagagggaggggaaatgtttgctatggcgtgactcacggcgggacttcacccgctggatgcgatgagatcccgtgaggatcgatcaagaaaatagtacaaggagaagaacagtatgataaaaagactattatcgatgctcttgtcgcttgctgttgtcctgtcgatcgcgccgccgatcacggcggccgcggcagacgatggcatcatgacggtaggcaccggagcaacggcagcggatccgtatgaactgccggaggaagcattcctgtgggaaaagtccggtgaaaaaacgaccctcatcggcgtcagccccacttggtacaaaacccatgttgaggatcggaatatcgagtatgtttcggtaaagatcccggcaacaacagtaaagatcgatcgttgctttgcgggtgcatacggttccagcaactcgggctataattctgccggaacgcaggagaatagcaccaatatttccggtgaactggtagcggtcgatttttctcaggcaaccgagctgaaaacgatcgatgttcaggcatttggctttgtgtctaacttgaccggcgtcattgacctttccaatacgcaggtggaagtgatcgagggcaatgcattcaaaaaaacagccattagcggtgtgatattgccggatagcttaaagagtatcggcggtaacccctcaagtccgggttcacatgctccggtatttggtgaatgcaaaaacctggaatatattcgcctagcgagcagcgcttcgaataaaattatagaactgccttctggcttggaaacgatcaaatccggtggactctaccttgaggaaacaaagatcgaacagacgatgaaaaccagtccgtttgtcatcacaattcctgcgtcggtcaagacgatgcagagtacagcgttttgttttagtgataatacagcaagtgctaacgcgcagtatgcttttgaaagaacagatttctctgacactaattatgataaggactgtttattcgaaaaaagctggaaaggcagctggggatttgctcggtttgccagcaaggatgcctatgatagctttgtcacgaaatatcctgacagcagcaagttttacggctatcccacctatgagtttgacctgacctttaaggataaggaaacgcagacgaagctctggggccagagcatccagtatgagaaagacagcgataactactggaagctgaacacaggctacgcgctcccagacgcaccgaccgggcaggagcccactgtggatcagagcgcctactgggagttgaacagcaataagctgacaacggacaccgtgttaacggcatctgcctcggcaacagaactgaccgctgtgtggacggttgtggacaagcttgctgagccgatgatcgcctatacgctgaacggcaaggtccagggcaatctgtccaatgggacaccggtattgctgaaagtgccctatgtaaacggaaaaccgggcaagatcggtgtgaaggcggtccaccctctgctgaaacctgaagaaggtggaagcggaacagatgacaactatgtctattttaaatatagatggatagatgtgcagtctctacagccgggacctcgctccagaacgatagcagatggctctggattctacaataagacagagagaactgccccagacgcaaaatataatgaggtcgagatccgagacagcaacgataacagagtgaagatgtcgggtgcatggggaccctataccttctacaactgtgaaatttacggttaccatgtgcagaacggagtggaaaaactgttctatgcttccaatgcatttggtagttacagtttaagcttcggtgatgctcccggccttacgcgcacaacagataaagcgttttatattcaagccaaatacatagatacttggaccgtgacttttgattcgaacggcggcaccgcgcccaccggtacggattacagtccgaggcaggtagaaaagggcaaagggatctctattccctacgagccgcagaaggaaggttatacttcctgctggaagaaagcagatggaactggagaatactacggaaacgattattttgagccggacagcgatgttaccctggtcgcccagtatgagcctatcgagtataccatcaagtatgaaccgaacctgacgggcgccaccggcacggtcggtcctcagacctacgaatacgacacagcagacttcaagctgaccacagatactttcaccaacaccaccaaggacttcctcggttggagcctgacgccagatgccaccacggcggactatgttccgggcgcggccatcaacgatgcgctgaaggcggcaatggtagcctcgacagatgaaaccgtcacgctttacgctgtctggaaggataagacaacgcacactgtcaccttcaacgccggaacaaacggaagcttcaccaacgcgagcgatcctctgatcggccagacggtcgttgaaggcctctctgtcaccggtgtgcccgctgtcaccggcaacggcagataccgcttcgacggctggaagctcgagggcgacaccacgggtaaggtatacaccaatgacgaagtgaaggccatggccatcaacggcaatatgacctttatcgccagctatacctatgtcggaggctcttccggcggcggaagtggaagcgtcagcagctacatcatcaaagcagcggccggtgcgaacggttcgatcagtccaaatggtacgatctcggtgtccagaggcgcggacaagaccttctcgatcaaggctgacgcgggatatgagatcgcggatgtccgcgtggatggtacgagcgttggcgcagtacgaacatatgagttcaagaatgtgacgaaggcgcatgagatctatgccacattcaaaaagaccgaaaatgaacctgagcaagaggtagctgatccggagaagaccggcgttgcgggtctgctggaaacggtaaagcatgatgcctacctgcatggctacggtaatggggaatttggcccgaacaataatatgaccagagcagaagctgcgcagatgttctataacttgctgcgagagaaaaatgttaccgtaacggtgcggtttacggatgttcctgatgacgcatggtatgcgaccgctgtaaatacgttagcatctttcggcatcctgaagggcgtcggagaagataagtatgatccgactcgtgcaatttccagagcagagtttgctgcgatcgcaacgcgctttgcaaaggtaaatcttgaaggaagcactccctttgatgatgtgtcggatgcagactggtattataatgccgttctgacggcggtcaattatggttggatcaacggttacggggataacactttccgtccgtacaatacggtcacccgtgcagaggtgacgaccattgtaaacaggatgctcgcaagacgcgcagataaggattttgtggcagatcatatcaacaacatgagaacattcaacgatgtggatagctccttctgggcatatcattacatcatggaagctaccaatggtcatgactatgacagggttgaacacactgagatatggaaaagccatacggcacagtaaagaagaagtgacggcatcgtccttcttacaataactctctgtaaacgagaaatccattgagcaaggagggaggggccggaaacggccccttccttctctaagtgcctatcttgtatagattggcatttagagaaggaaattacttgtctttgcaattcaaatctatggaggaagcaattttatgaggaaacaccaagcgcacccattcgccgtaaaagcggtgtcggcggccttgaccgccgcactgctgcttgccccggcacagagcatcgcctacgccgcagatgcaggcagcacacagccgcaagaacagcaggtctcggcatttcagttcaagtatcctacggaccacacctttgcggagatcaatcagttctacgcagaacatccgtatgacacttctctgccggacaagtatgacatccagccggacatctccaacgaagagatcaacactcgcatcggcacggacaccactgctttgctggacgcaaagggcaaagcagaccgcgatacgctagcgggcagtctgacgcaggaaacgctgggcaatgccctcaacgccaccaactttatgcgctacagtgcaggcttgcagctgctctatatccacaccaatgaccgcatcggcggttaccagtggagagcgcaggcaggcgcggcgctgatggcagagctgaataccatcacccataatgtcgatggaaatgaagcactggcggcaggcgttatgagtggtgtgttcggatgggcaaaagcaggccccggcggctccaatatcgtggcgggcagcggcgtggcgaataagatggtcaacagtttcatgccggacatcggaaatgacaggaccggcctttcccatcgcagctacatccttaaccccggcctttccggaaccggtttcggggcggctgacctctccggcacgaaaaatcccaagactggtaaagcaagaggctccgctgtttcgatgatggttacctattacggcgcagacccggatggactgtccgccgtactgtggccttcccgcagacagcctatcgagacctttcaggctcgcggcacatggcagatgagctatccggagggcaacccctatcagggcaatccgtggagctatttcatcaatacggacagcgccaaggtggatacctctaccctgaaggtgacgctggagtgcgacgggaaaccaacggatgtattggatctcaacaagctcacagcagcagaaaagtccgagaaccgtctgtttaccatcggcagcagcccactcaagcggcttatcgccttccgccctcatgtggcctatggcgcaggagataaggtcaaggtgaccatcgagggcattgtagatgcgcaaaatctgccgatccccgtaagctatgatgtccatttcttccagacaggcaccgagccgcaccccaatctggaacagaccgctgtgagcagaacagcagcagatacggcggagttccggttcactgccgactacgccggtacgatgcactaccttgtgctggacgccaatcagccggagccaagtgcagacgcggtgttgggcggcacgaagctggctctcggcactgacgaagctcttctcgccctcaccggtctgaccgggaacagtgcgaagaagctctattacatcactgccagcagcacggctgcgggcaaggaccatacgaccgctgacaaaagcggcgagatgagtgcggtaaagtccatcaacattgaggaatatgtcgcgccgtctatgacgctgaccgatacggcggcagtccgcgagagcaaaagcaccggtactgtgaccttcaccgcacccgttgcgggtacttttcactatatcgtgcgggatgtatccgaactgatctgcgatcataccgaagtcctcaccggtacggaggctgtgatgacggttggcgaaaatcagatcgctttgaccggtctgacggacaatgccgcaaagagtgtatttctctacgcgcaaggcacggacggcagcaacagcgccgtcacccgcatcgagcttccggcgtatcagcctgctgctccgtctgtgaccgcgcctacggcaaacaccctgacctacaacggcaccgcacagccgctgatcaccgcaggcagcaccagcggtggcaggatggaatatcgcctgggcaataccggcgattatagcgccgaagtccctacggcgaccaatgcggggacatacaccgtctggtacaaggtcgtgggtgatgatacacatgacagtgttgcagagcagagcttttccgtgagcattgcgaaggccaaggtcacagcaacagcgaaaagctatgccatccaaaccggggacaaagcgcccgacctggcagcgcccgtcctcggtgagcattacaccgtagacggcttgttcggcggcgatacgctgggcggaaccgctgcgctcacctacgaaaaggatggtacgccagttacaccagacacaagcgcagcaggtagctatgacattgtcctctccggtgtgacggaacctatgggtggtaactatgagccgcttgtgctgaaaaacgggacgctgaccatctcggcgcgtccgtcctccggtggaagcagtagttccagtaagccgacctatcctgtcagcagctcgtctgtgaagaatggttctgtgtcgttcagtacccgtagcgcgtccaagggcagcactgtgaccatcacggtcaagccggacaagggctatgagctggcgtccctgatggtccgggacagtaacggcaatcccattgccgttactcctaagacggcggacacctacaccttcatcatgccctctggcaatgtaagcgtggagccggtctttgcgccgatcaaggcacagccggagttcaaggatgttgcgagtgattcctattattatgaagcggttcaatgggctgttgaaaatggcatcactgaaggcaccagcgcagataccttcagccccggtgcttcctgcacccgcgcgcagatggtgaccttcctttggagggcggcaggcagtcctgcccccaagagcgcggcaaaccccttcaaggatattagcgcgaatgattactattatgaggctgttctgtgggctgttgagaatggcatcaccagcggcaccggcgcggataccttctcaccgggcgcaacggtgacccgcgggcagactgtcaccttcctgcatcgggcggcggggtcgcccttggcaggcagctccgccttcagcgatgtttcggatagtgcctactatgccaaggctgtcgcttgggcggcagaaaacggcattaccagcggtaccggcaatagcaagttcactcccaatgcagcctgcactcgcggccagatcgtgacactgctgtatcgcgcccaataattgatatttctcttcactttcctcttttttctctttcttgggaggtcggggacatttgtccccgccttctccaagcgcttgaccattggtggagcgtttggagaaggaaacaatgaaagcaacgcgccacctaccagatatacggtataccgtttgcgatgccatttcatgagaatggccagacatggccggtggatcaacaatgcttgttatccacaagaaatccagcatcaaaggactgagaacgatggataaaaaaatcgagataacgctgcaagaatactgtactgaaaacaatcaagaagcattgctggaacagtgggatgctgagaaaaatgcgccgctgtcaccagaaaccgttagtgcaagcactcacaagaagatgtggtggaaagattcgtatggtcatgaatgggcacagccggtctatagccgcactgtgcaaaagcgtggatgtcccatctgtgcaaaccgagtggtacttcccggcttcaatgatcttgcaacgacatatcccgcattggcttcagaatgggatacagaaaaaaacggaacgttgaccccacagcaagtatttgccggcagcggtataaaagtttggtggcggtgtaagaagggacattcctggaaggcggtcattgcctccagagccggaggctgttcctgcccggtttgcgcgaatcgtatcatccttcccggttttaatgatcttgcaacaacgcacccggttcttgctgctgagtggaacaaagaaaagaatggggacttaacaccacaaagaatcagttatggttatgataaaaaagtttggtggcggtgctcattaggacatgagtggaaggcagcaccaagcacccggatccgcatggcggctggctgccctatctgctccggctatgccgtacagaaaggatacaatgatctggaaacactctatccccttgtcgccgcagaatggaattgtgaaaagaatgatgcattgacgccggatcaggtagtagcgggcagcaatcgcttagtttggtggcgctgttcgttgggacatgaatggcgagctgttattgttgatcgcacagtcggcacaaacggatgtccttactgctctaacagaaaagtattggcaggtttcaatgatcttgccacattagagccggagatcgcggcacagtggcatccaacactcaatggtgagttgctgccaacacaacttacagcaggcagtagccgcaggatctggtggatctgttcggaagggcatgtttggcgtacatccgtagcaaaccgaacgaatgcgaagaaacgcacaggctgtccggtttgtgccggaaatatcagcaagcaaaacgcgctgtactatcagaagatggcagctcaatcgaacaactactgccatttgatcggcaccgaacggaatgatcctaaaggttcagagcgtggcttaagtgtttatccggaattaaaggagaactgtcatatagaaacaaagaaatgacaaaggagcagagctgtatggacatcaaacaaatattagatcaaattgacgagatcatctatatcgctgatctggaaagctacgaattactctacctgaaccgaatcggccgggagcgctttggaactcctgcaccgggcgtgaagtgctacgaatttttgcagggcgaagaaaaaccctgcaaattctgcacgaacggagagctgtcgcacttgcaggataagcgcatcacatgggtgcgtcagcactccgcggcgggcaatttactgctgcatgacagcgtgatcgaccacgagggcagaccctgccgtatggaagttgccattaatgtgaatcgctatgttgacgagctgaataccgcacagagcgatctggcggcggagaaaaaacttacatcctgcattgaaaatcttgttatgaacgatgattttacagcggcgatcaactctatgttgaataccattattgaacattacaatgcggatcgcgcctatatctttgagtttgactgggagaaggatgtgacccgaaacacctatgaggtgtgccgggaaggcgtaacgccggagatcgataatctgcaaagcctgccgattgccgtggtcgctgtgtgggtgaataacttcttggatggaagcaacaagatcaccattatcgaggatgtggacgcgctcaaggacgatcccactcgccgtatcgagtatgactacctgcatccgcagggcatcaagagcctcatcaccgtccccatttttacaaacggaaaactacatggctttttgggcgtagataaccctcacgctcacatggacgccccggagctactgtcacaggtgacttacattgcggcgaacgagttacaaaaacggatactcacagaaacactgacgaaaaaaagctatcaggatccgctgaccgggctgaacaaccgtcttgcctatgacgaaatgttagccgatctgcttggcaaaaaattgcccaccggcgttggctttgttgacttgaatagtttgaagtggatcaacgacaattacggttacgaatttggcaatcgggcgatagagctggtgtgcaagatactcaaaacgcattttcaggaggactgcatctaccgcatcagtggagacgaattcgtcatcatttggccggatgttgattatctgcaattcaaaaacgcagcgggaaaggtcgctgcggcgttgatattggagcagaacattgcagcatttggctacacatggggacatgaggaagatgtcgggatcgcggtccggcgggcagaaaaagcgatgcaggccgagaaagccaagtattatgcagcgattgaaaaaacgaaaggagtacgtccgggtttcgtagagttgttgctgcaagaatttcgcgacagcaccttcgtgccctacctccagccgctgtacagcatccagaatgataaggtctatggcgctgaggtacttgtacgcaaggtcgatcccagtgggcatacccatttcccgcaagatttcgtttccatcatggaacgcgagggcatgatctccatggtggactttacgatgctgcggcaagcctgtgagctgttacagcggtggaaaacggcgtggccggaacttacgctgaatgtgaatgtttcgcggttcacattatctgaaccggattatttgaccagagtagacaagatcattgcggagaccggcgctgacccgactcggctcgtatttgaagtcaccgagtcctttgtggagatcaatctggaatcgttgtccgatgtgttaaacggattgatctcacggggcatcaccgttgccatcgacgactttggtgtcaatgcgtctaacttgaatacacttggtttgtcgcagtttagcattgcgaagctggacaaaagcctgatcgaccaagcagagcacagtgagcggatgcagtatgtggtcaaagcggcgattgagctgtgtcacaaattgaaaatgctctgtgtggcagagggtattgaaaccgacagccagattgaattgttaaaagcgctcggctgtgaccgcctgcaaggctacctgattggcaaacccatgcccgcagaagatttctttcatcgatttggagagactgctctccacaaaaaataaggaaaaggacttgagaaatatgagaacctacataaaccagcgtggtcggcttgcagtgcttgtatctgcaataatgatcaccgcaatgatcgccggactgatccccacggcacgggcggcaggcacattgacattctcagatgtacctgaaagccatacctgctacgcggacattcagtgggcggcagacaacggcatcgtgaacggatacaacggaaaattcaacccagatgggaaaattacggtggaacagttctgcacgatgctgtcgaggagcattccagaggatgagcaggacacgggcaatcttggcgcagcaaaggactctatgcgctatcatctgcgccgcgtggtgcgtcatggttggacaggctatggtgcagagcttgaattacaaaaggaccgtaccatccaagctggcaacgcatggaactatgcattgacggcaaccgggacacaggtctattccagtcggctgtatggcgcaaacccaaataccaacattgacggaatgcgtactgccaaggaactgggacttgcgactaaggacgctgatgcaacggagatcatcaccagagcacaggcggtatccatcatccatgcggcgctgacgaataccaaaactgcacaggagccgcccatcgtgaccgagatgaagggtgttgttcagaatctgcctcagagcgcgatcaatgatttctatgcagatatggcaaaggtgccggaaccgatccgcaaggcatttatcacggacggctggaagatctgctttgataccgggaaaatcaatgaatactcggataaaagtggcatttacagcattggcggcatgacggtctactcggaaaagacgatctacctcgccactgcaagatccctgcttcacgagatgggtcattactatcaggaaaaaatcaagactaccggtattgatagaaatgtttacagcgcctttgaaaccatccgcagcaaagaaaaatggagcggccccctgtattccagcaaccggcagacaaacggagcagagtttttcgctgacgcgttcagctattatgtaacgtgcggtattgtgcgggccgaccccgctggtacggatgcaaaagcaacactccaaagtcaggaatattttgatgagcttgcggcaaaaggctggctttttacacgctgacgctgaccttgttgaacggataggagtgtgccatgatctacggtccttataagcggcagagcaagctgccatccatcaaaccggcacagcgggtaaaacgtcgcaactataaggcaagaccgggtaaaaccgttctttgtctgcgcgctgctttcgccgtttgcattgccgcgctgctcggttttggcggcagggtgctgtatctggatcgtgcggcaaggacggcgcggggcgtatatgctccgtatgttccggcagtttgggaacttgtcctgatggttgtgctgtccgcaagcaccttgctgttgctttatctgctggagcgaaacggacgaagaaagtgaggagtgatcccatgaaaagagtgattccaagcgttttagttgtgatatttccttactcgatcctgtggcatttgtgctgggtattgggttgggggccgatcgcatttccgaaggactggacgatcgctgaaatctacggattgatcatcctcacatggctcattggacttgccgcaaccatttggttgaccatcgtcaacgcatcctctaaaacggatgcgaaaacagcggcatggagcaatatgctgatcaagctgctccaagccccggcatatatcctgctattcattgccggagcaatgttctccacgatcatttttacttggctcattacctttacgatcatcgtgacggatgtcatgacgattttcctcaccggcatcaacggcatcgttgctgcctgcaagtgcagaaaagcaggtttgctcaaaaccagcggtgcggtgtggtttagcatctcgcagtttatctactgcgtggatgtggtgtgcgcggtgaccctgtatctcaaagtgaaaagagccatagttcgtaacagagattgattttaggagggtacgaatcgatggagtttcaaaaaataaaagaccagtatgaacagcagagaaaagcggagcggagcaagctgatcgcatatctggaaaagcacgctttatttacgaatgcagggttgaccgtcctaaaaggcggcggcagcgggagaaaaaattatagttccagtggcaggattttcccgttcaatcttagtaactggaaatgggttgagtgcgaaaatgctagaggcagcttcaatgcggtcatatccctgaatatgctcgatgacgatctgtcctctggaaacgcgcacgcgctatacgacagagtcggattgatcctgacctatcggcatgagaacaatacctacaagacattgatctgaatggatattgatctgccattttcggatgagagcatggagaagattgcaaagctcatcagcgaacagtttggagtctataactggatcactcactgagtaatgcgagccaccgaaacatttaaggaggcgatgaaaaagcgtgtcagtctgaatgtgtttagagcaaaaaacagggatgtagttgcgcacgatatgatgaatttcctgatcccatacggcggagccgtccggctctgctgccgttctcgcgtggaaacttaaagtaggcactattgcggtcatttttacccgcagtagtgccttttgctatctccacccgattcggtgtcgtggtccgccaccgtgaggatttcaaaaattctcacgaaatggaggaaccgatgctttggattgggagaaaattctggcggatgaggagcgtatcatccgcaacgcagaccggcgctttcgccggcacagctattcactggaaagcatgagtgaggagcttgttcacatggaatgccgcctgatagagcgcagtgacccgttggaggtggtgctcatcaccgactttgtagacaccgttcagaatgagcgccttgccacagcgctgcgtcagctgacggatcgccagcggcgcatgatcgagcttgcttattgggaggggtatccgctcaaagacattgccgtcatcatggactgcaagccgaacaccgtttctcagctgattagccgggcaaagcggcatctctacatcgctctgaccaggtaaatgacctaaagcaagaccagcacccgcaagtgctggttttgccttagagcatttcaaaaatttttttgagtatagattttttgccttctgccgtgaccgatgagtagagggttttatcctcaataatattcaggaggtacttacctatggaaaaattgattcgtgtgatccgtctacatcctggcgaaagcgttctgatcgtcgcgccggaggacacgccgacgccgcctgcggctgtactgctcgcagcggaactgcccatgccggacaagctgacggaggagatcgccatgctgctgcgggtggtgtaaatggcggtctatattgtgacggtgccggatgcggatcgccagatgcaagcggtggaggtgtcgctggaagtctatcaggtctttattgatgggcatcgtgcagaacagcgggaacgctatgagcgccgaaagcatctggacagccgtccgctggaatgctgcctgtacggaaaaagcgtatccgaaacgctggaggaaacctttgaacgaatggaattggcggaaaaggtgtgggcaggtctatcacgcctttctcccaaacagcggcagcgacttatccttcatttctggtctggctattcctatgcggagatcgcggcaatggaaaactgcaacaaggcaacggtgatgcgctctgtaaaaaccggtctgaaaaaatttcagaaatattttttgaaaacatgacaactttcggccgatttccctcctatatagtgagaggaacttttagagcctttcatcgtaccttgataaacagcggatttccgttcatatcagcattcaggaatttgagtgcagtggtgagcacgacaaagtgaagcgccaagacctcctgcggatcggtcagatgatccgtcaaaacgataacatcaaaggagcagagcgataccttcactgctgatacgcctcttgtggtaagaggcgtattgccacgacccattgcaggagatgccaaacagatcaccgatctcggagtgtccgaccaagaccgacctgaatgttcccgtgtaccgggggtgagccgaggacaagccaagtccgacaatacggtacaaagtgcaagaaaagaaaatcggcagtgcgccggagcagaaatgcttcggcgtactgccttgtcataaagaaacgggtgataaaaatggatgaacaaagagaacctgatctcatctgcgaacgcaagatcaagggcacgacctacatcgtttcctcattcttcaaccctgatgccaaagaaacggcagcagagaaaatgggccggatcatcgaacgcgagttatcttgtcaaatgagcgaataaaaaatttatcactttagtgcgataaatcacttcccagaatagcggcgatgcggtataatagggacatgacccaaagccttttcgttcgcagattggaggaacttatgttacagtcgaatgaaaaggacaaaattgaatatgtcgctctctactgccgcgttgaaaacaccgatccgttttctaatgaagcagtgaaaatgcccatggaacactgtgctgctctcctgaaagggggtgcagtacgatgataccgaacctcaatgatctgatgtcctttaagccgtctgtggctcctgatgaaccgaccgcgctgtacgccagactttccgtggatgacgcgaacgatggtgacagcaacagcatcgtacaccagaaagaaatgctggaacgctactgtaaggacaacggctacaccaattacaaattctatgtggacgatggcttctccggcacgaactttgatcggcctgactttaagcggatgatcgcggatgtagaagctggcaagatcaagcgcgtgatcgtcaaggatctgtcccgtttcggtcgtgactatcttcaggtgggaatgttcacggaagtgctgtttgcacagtacgatattcacttcattgcgattgctaacaatgttgattcgcagaaaggtgaaaatgacctgacgccgttcgtcaatctgtttaacgaatggtatgcgcgagattgcagccgtaaacagcgagcagttcagcgcatgaaaggtacttccggtaagcgtttatccacgcaaacaccgtatggctacctcaaaggcgaagatgggcacttgatccccgatgaagaaacggcatgggttgtgaaacttatcttcgacctctgcattcagggatatggaccgacgcagattgcaaatgaactcacgcgtcggaacatccctacaccaggaacgatggagcatcgccgcacagggaatatgaggcattacagtccggaaacagaatgcgtatggtgtagtcgcacagtttattttattttggcaaggaaagagtatttagggcacacggttaacttcaagacatactcgaagtcgtataagctcaagaagcggatacccacaccagaagaacagcaggtagtatttgaaaacacgcacgaagcactgattgaccaagaagattgggaaacagtccagcgtatccgcgcggggcgcagacggctgaacaagcaggagatcccggcgctattctccggtctgctgtattgtgcggattgcggttctttgcttcgtgtacatcgcggaaaaaacatctccaaagggcaggaatgctattgctgcggacgctatcgtgtacggaccaaatcctgctctatgcactatatccgtgaagtgacactggcagagttggtgaaagacaatctcaaacagatcgtgaaaacggctgcggaggatgagcaggagtttgttcggagattgacctgccagagcgcgaaagaacaggctgttaagacccgtgttctgaaaaaagaactggagttgaaagagcggcgtgtcaaggagttggacggcattatcaagcggctttacgaggacaatattaccggaaagctgtctgatgagcgattcaaaatcttctctgcggattatgagcaggaacagcattcgctgcgggaggaagttgttgctctgcaaaagcagttcgatgacgcagagaatacctgcacgaacatcagcagcttcttgaaaatggcgaaacgctatgctgacttcgatgaactgacacctgctatgctccgtgacctgattgagaaaatcatcgtttatgagggcgataagagcagcggacaccgggaacagcgaattgaaatctactacacctttatcggtgcggcagaaaattcgcaaatcattgtaaaacgcaagaaaaaagcagcgtaacatacaaagtacattacgctgcttctctcatcagttaaaaaacttccttgttgacatcaggctaaagagccttcctttcaggtcgcaggcctcacagacttctgcgacactaatcactataagcagtatagcatagcaaatgtcggtccgtaaagcgccgagaaaggctttattgttcagacggtattattcccgcattgtcgaaagcagcgttacgctggtcagcacaacatccgcctgcggcggctgaggaggggaccagatgttagggcgaacggcctgaagatggttatttacgatcaggttctttccgagcgattgctgcagttcaacgatgtctgccgttgtcaactcgtgatcgcggatgatgttggtttcgccaaagcccttaacagggttctgttttgcaacataaacggtgtaggcgtagccgatgtagtagagatagttcatgagtggttacctctttatatgttgacttgtgctcacattgagcagaggctaatgccaaaccctcagcgttttgagggtttggaagaagataaaattacatggtactcaaacaggtatagcgccatttttgagtgtcggtaaggtttggaagaagataaaatcacatggtactcaaactcaaaaaggcctcgtctgattggcccgactgtttgggaggcggaagaaattgcagagttctcaaacaaccgacttaatggaacaaatctactccaaggtttggaaggggaagaaattacagggttctcaaaccatgatgtgattattgaaaagctacacatgggtttaggaaagagtgaaattacagagttctcaaacgtcacgttaccgtatcaaaagcctggtgcaggtttggaggagaatagaattacagggttctcaaacacatttttgccccaatcgacgctttgaaaagtttaggaggcggaagaaattacaaggttttcaaactgaatatcacaacgcgcggcaacgtcgtttggaaggcggaaggaattacatggttctcaaactcgaaaaactgttccgaatgttgcactgtgggtttggcagacgtgaaattacatggctcaaaccggattttttgatgtgccgatgaatttccagcttggaagggtgaattacatggtactcaaacgcacagaaatatacaggaaacaatgaatttggtttggaagaagatgaaattacagggtactcaaacggaaaaaatcttcatatagcttgattttatggtttggaagaagatattacatggtactcaaacaggggtgtccccttacaagccggggtctttggtttggaagaagataaaattacatggtactcaaacacagggagtattcatcatcaaaaagtgctgggcttggaagaagataaaattacatggtactcaaacgtccagcggtctcggccacagtcgcggtgcggtttggaagaagataaaattgcatggtactcaaacccctcgctgcttcgcatcactcggtaacatggtttggaagaagataaaattacatggtactcaaatccctcctcgctacgcattgccggtaacaggtttagtagaaggtaaaattacatggtactcaaacaccgattttccggggtgtttggcagagtaagttttgaaagaggaagaaattacagggttctcaaaccggaaaggttcatttgtattgtgctacaaatacaaagaaattgtagggcactcaaacctcgtctacgtggactgtgcaggcagaacggtttagaagaagataaaattacatggtactcaaactcgtgctgctaccgatccactcgttttggagaagaaaaagctacatggtactcaaaccagatttttttgatgtgccgatgaatttccagcttggaagggtgattgcaggattctcaaacaagcactctgcgtggctgcgctggccttatggcttggaggggaatagaattgcagggttctcaaatcttttgcgaaggaggaaacggcgtccacgcgattggaaagggaatagaattgcagggtgctcaaacgacgccgccatctgaagcaaacaaagcaatgttttggaagcgaaagaattgcagggtactcaaacgagtgtgtggtcgcgctgacaatgttttgtggtttggaaggagataaaattacagggctctcaattagactttctctaacggaagttgagtgcataaaagctttggaagtaaaagaaattacagggtactcaaactcggtaacatgccaaaggcaacagtcgatatccagccttcagattttaggtttggatgggggagaaattacatggtactcaaactcgtgctgctaccgatccactcgttttggagaagaaaaagctacatggtactcaaaccaggagggtggactaccgggttagaagaagataaaattgcagggttctcaaacaacgcctccatcagaagcaaacaaagcaatgctttggaagcgaaagaattgcagggtactcaaacgattgacttacggagataggtttagaagaagataaaattgcatgatactcaaaccatagattaccacggcggaagtgctttggaaaagagtaaattacatggttctcaaacgatgtacaatatcgctcctaagtcgccaccttgggttggaagaaagtaaaattacaggccattcaaataagagagaaaaaattgcaaggctctcaagaagggtacccaaagggtccgaattaaaaactcgaatcacaaacgcttggtcgcaagaggagatagacttgtgctcacaatgagcagaagttgatgacaaaccctccgcgttttgagggtttggcagaagataaaattacatggtactcaaacgaggaacagcagtcaacttgcggaagtctcggtttggcagaagataaaattacatggcactcaaactcaaaaatgcctcgtctgattggcccgactgtttgggaggcggaagaaattacagggttctcaaacatcatgccgttctcttatccgcgcctaatcgttttggaagcagaagaaattgcatagggctcaaacacgaccgtgtctcgtgctacacaaaggtttggtttgggagtataagaaattgcatggtactcaaatggacatagagaaatccacacacccctcaatggtttagaagaagatgaaattacatggtactcaaacgcgctgatcgctccgctgcacatgccttacggtttagaagaagataaaattacatggtactcaaacacacactcaggtgtaacagtcggcaggtggtttagaagaagatgaaattacatgatactcaaacacacagaaatatacaggaaacaacgaatttggtttgaaagaaggtaaaattacatggtactcaaacgcgtcgtttctacataaagcagcatatctcgggttggaaggaagtaaattgcagggtgctcaaacatcaccaaagagcctcagcgttgtaaggaagcaaaattacatgatgctcaaaccttgcatccgttgaaaatcacgaatgtacaggtttagaagaagataaaattgcatggttctcaaactgagatggttcacctgtactacgctacaaatacaagaaattgcagggcactcaaactcaagagactcagtcagacgcacgacatcgggtttggaagaagataaaattacatggtactcaaacacatgctacactttgatgaaaaattacagagccctcaaattcggtaacacggtcctacggcgctttggagaagggtaaaattacatggtactcaaacatatcttgtatggcaaataagatcagcccactttgaagaagagtaaaatcgtatggttctcaaataaacagggcctaatatttctgcgtacatttctacttgaaaggcacaaagaaatcataggagcacttgtgctcactttgagcagaggtcgatgagaaactctcagcgttttgagggtttagaagaagatgaaattacatggcactcaaacgtcgtcattggttgccaaaagggactggcaggtttagaagaagatgaaattacatggcactcaaaccagcatagcccgcaactcgtgaaccgtgtaggtttggcagaggataaaattacatgatactcaaacaactcgtacagctgcttaaagaaataagtcagtttggaagaaggtaaaattacatggtactcaaaccagaccatagccggacggagaaggtttggaagaagataaaattacatggttctcaaacaattcagttccatttatatgttacacactcgatttggagggatgtgaaattgcagggtgctcaaacagatatccactatattgtcaagtcttttaaggtttggaagggtgtgaaattgcagggtactcaaacatcaaaaaatcaaagagccgctgttttgtaaggaagcaaaattacatggtgctcaagccctacagccgttaaaaatcacgaatgtgcaggtttggaagaagataaaattgcagggttctcaaacttgctattgcgctgcaaagacaaagaaattgcagggcactcaaacatttactggctgatcgttacggcagcaaagggtttggcagaagataaaattacatgattctcaaactttttcattgttattcccgctttggagaagggcaaaattgcatggttctcaaataaaccagtggacaagctgcgcccaatggagctttggaagaagagtaaaattacatggtactcaaacgaacaagagcgcctatctccgcaaaatggcagtttaaaagaagatgaaattacatggttctcaaacaagcaagatttcgtccgaaaacggaacaaagctttggaagaagagtaaaattgcatgattctcaaacatgtaccataacatcatcagcatcatcctgggtttggaggagtgtgaaattacatggtactcaaacacatgctacactttctagccagaacacacttggaagcggaagaaattgcagaattctcaaacaaggatgtaggcggttttgctttgtaattattataccatatcctgatagaaaagcaaacatttgttctattcgcttgagagcagaaaagggtgaagtttaggatgtgcttcacagagaatgtagatattccctgataaagaatgataaaaatgattatgtgagaactaaaaaacagaatttaagaaacaaaaaggaaaacgtatatgatttattatgatgattttagagcttttgcaaaagagcatgaagatgaaattttcgagtatttcgttcgagatggagaagatgctgcgcagtatggcacgatcatggaggtagtgccgctgccggacgcagattttctgattggcttcaatgcatggacagcatgctataacgataaggatttcaggctgtaccagcaagatgatctcgaatattataagctgagcgagattcgtctgagtatctatccggatttcgaagcagcaagagcaccgctaattggataagaataaaacgcggatagaacaatcggaatggagggtatgaatgcgattttgtcaactaccccgaccctaaagggttgagactgttggcaattaaacatatcaagtggtggatgcctatgataaccgatggctggcacaaacttgccgaggaacagccggaagaaggccagagagtcttagcaatgagttcacatggaaggtatccgatgcgatatggaaacgcttctttactatgtctgaacctcaattcgagcccttcgtctgggaggtcgtatattggatcgaaatgcctgcgctgccgcctgatgtaaaattcaaatacaggctttacttgaaagactttcaagtaatttacaagtagtttcaagtagaagctgctttccgccaatgacttgcattggctttgataaagaaatgaaaatgaaatgctgttgcccgtcctcagatgcgacaggaggacgggcaatgtgacgaatgtgaaatttaactactgaagattagaaacgcttacagcgcattgtagcgcttatttatcccacgcctcaggagccgcccccgccatcaccaccatcgatgccagcagtgcacaaggcgataccgtaacgataaaaatcaatctgcaatgcctattgcttatatgggcatcggaacccgagcgcatagaatcataacaataataccaatcagtatagttacgataaaaataatgcatgcaatctcaattttatattcttctttgtgcagtttgaacgctgcaatgagaacaattgcacttgcaagtgcgataatacctattcctttccataaccatgaaagttcatgtattaactgcattgtggtcacttcctttctgaaatcttgtagaaaaaatatgggataggatcaccctacgtgtgtggtggaaagacttaaaattatcccggtaacaatggtccatattagccatctacatttataaataccgaaaatctggtttttgtaacacaagaacaaattgcataaaaaactccgtctaaccgcaagggtatagatggagtaggaattttcggttgtgtgggtgttaatttgactgagggatatgcagtattttggcggtttcaagccatgcgatttcattggactccagctctttgatggcctcaaggcgagtatctccttgagcgacacagcctttcaggtgcaggctcttggcgatccagacacgatgcccattgacgctctcacggcttatggcgtagggatacaacatgaagaacagctcctttagcaataaaaacggattcatatgataaggtgtagcacaaggcacgagaacagaacaagaatacccacaaaagttgttgccattcctgtgagaaaacatcccatagtcaaagaaccaggagaggatttgctcgagtcttcaattagaaacgcagcaagtagaaggacgagcccaaaacaaagcaaaaagcgcctgcatgaatgttaagagggattatcatttagagttctccttgtttatgcagattttgaaagtagaggattttgcataggtctcaaactggggtacttgcacttcttccgccgacagcggtttggatatatttcgttttacataggtctcaaatttctaccctaaaaaacccgaggtttggaagcatctcgttttacataggtctcaaactatgatccaacacggcattatgtttaaaggcatcctgttttgcataggcctcaaacgcaaaaagccaacctaacggtggagggcagggctcaaaagccagtccaaaagacttttacatataagagaaaggtcttaatctttccgagtagctttgttgtaatcagcctgtccagccgcaataacagcggtcacgcaaacgaccgttgcgaaaagacacaggccagcaataatgccgatgataaacaaagaaatcgcctcctatataagcaaaaatggttgtgaatttacaaggttaagtcactcaaacgcgcgtagcggtacgggatagccgctgaaagaggttcgacataaggctcaaaccctgatggaacggatatttcatatccggttggaggtagatagttttacatagatctcaaatcatcttgttcaaaggggagtttaaaaataggtctcaaacggcggtcttgacatagctttcggtaagttagaggtatctgttttacatagggctcaaaggaggcgagtaattttacataggtatcaaactgaaaaaattattccatgctctcaatgatccttttagaggtataggtgattttagataggactcaaatgaccggtttgaacggtgataacaggataaatgatttcacataggtctcaaactggcagttccagaatctgttgctaaagccggttttagaggtggaccgttttacatagatctcaaatcaacagaagtcaatgtaatcaccgccaaaggctttagaagtaaatgattttacataagtctcaaactaatcttcgaatgccgttatcgggcaacttgttttgaaagtatttaattttacataggtctcaaacgtataaacaagctataagaggatgataggagttttgttggtatgttgttttacagagggctcaaacctactattagtcaaccaaaagcatcttaacagctagtttcatacaaccccgtagaatcaacgtacttaacatcgttatatccctgctttgctaactccattcccagcttaacagccttaatgaagtccttttcgtcgaacagatctcgaccaattaccgcatcttcggggcattcatttagattccatgccgaaaacaccatattgtcgttctgatcgaaaagggaaacgccaacagcaaagtctaagtcgtctgtctggtattcggcattaaattggtatgtcttcttcgtcggaatcgctccttgtgatggaattgagaggtagataattttcacatagggctcaaactcccttcgactttgtcgatttggcgaaagttttgggtgtgagtgattttacataggtctcaaaccacgctgctaaaatgcatgtgattaggcctcaaaccgcaagaacggcagctacattaccgatcagggtttggaggtatatggtttcacataggtctcaaaccgggatctttggattgatagtgggcgaggtttggagatatcgtatttacataggtctcaaactcagcagaggtctgtaagcccgtcaccttttggttggaggtaggtagttttacacaggcctcaaactgtgggtaacacagtcggcaggtttcaagggagttagaggttttgattctacatagggctcaaacaagcgacaagctatttttgatgaaccttcacctctaacggttttcccttatagaggtggtatctttggcgggtattttgttttactccgctcacatattttcatggagacattcatcgccacaataacaacgcatcgcaagtgtacctttactatgacgattgatgatttcaaatgccgtatgcgtgggcatctctataatccagaatccattgcggcaatagctcttcggcggaagataaccgaattcgaagagatcttgtttaatagtctcaacttcagcttcggaatcacacatgcttaaaggccaaatgaccagtgtgttgcggttagcgaaattagactttagatatgaacgaagcatatcgtcaatggttacatgttctaatttcataatagcccttctttctttaaacgcaacatttgctttgtaattattataccatattccagtgaaaagcaaacaattgttcgatgcccggacttatgcagtttttgcattagcgaaagggaagtgaactgtgatatactacaaaatttgcgtcagaatcgctagtatggcaggggacaagtagttcggaaagaaccccttactcttgcccgtatcgtgcctcatacgccgtctacacgtcgctgcagcctattccattttgcacttagcagggttgacattggtatggtataatgcagggtttgggcacttttttatttgtccggagcaaaaatagtcttcaaataagaaagagaaaagaggtgtgaaaaatggtctatctcccatatgttcgttttgagcaggaagaaggagaaggtcgaagctggcatgaaacagagttcatgccggactgtctctattaggttgcggatgcttgatactgcgcaggtggaataccggaaactgagtgaggttcatctgcagtgtcgtgtagacgataatcagcctgagtgattgggcaaaaagaaaacctctgctcatattgagcagaggagtgtagaagccaaggcccatcagcttttacgcctaacaaaaccatagtaacacctccgtggaatcactcccacatatgtggggaaaattgctttgtaattattataccatattccagcaaaaagcaaatttgttccatttatcggtgggagaaaatgccaaccatttctcggtatcggttgaacgcggaacgccagaacgatggggttttaacgtgtcatttgtatggtttttaacgtgtggaatacaagcagtgatattgtaacgctaaaaagtcatcaaatgacacgataaaaagtgtcggtaatgaaatcctcattaccggcacttttttatttgtccggagcaaaaatagtcctcaaataagaaagggaaaagaggtgagaaaaatggtctatctcccatatgtttgttttgagcaggaagaaggagaagcggagggtatcggctggtactttacgcagtataatgccgaaactggggaaggtaaaggctggcatggaacagagttcatgccggactgtctctttgaaacgaaatgcgagggcggcgaaccggaaacaaagttctttgatgtgaataccaatgagccaatcaagcagtggagttggccggaaccgccggatgacaatgcgttcacgaactatggctcgctggatgagtttgtagcgaataattcgcagaaggtgttccacattgttgaccgcaataaatgagatccgcctgacaagctgcaaagaagacatgggatatgcgttttaccctctatccacaccaaatttaaaatagcccatctcgtcgcaaatcttgacaaaatccgcaaaaaccgatacaatataaaagttaaaaagaaatttcggctcctgctctgacggcgggagcctttttggaggaaaactatatgcaactcacattatgctgcccgaccctgttcgggctggagggcatcgtcgcggacgagctgcgcttcggcggcaggctggccgacgtacacgcggaaaacggccgcgtgctgttcaccggtgacgagaacacgctcgcatgggcgaacctgaacctgcggtgcgccgagcgcgtgctcatccgcatcggcacattcaaagccaaaacgttcgatcagctgttcgagggcgtaaaagcactcccgtgggagcagttcattccggcggacggcgcatttccggtcaagggtcacagcctcgactctgcgctgcactccatcccggactgccagaagatcatcaaaaaggcagttgtatcgcgcctgggcgcaaagtacggtcaaacctggtttgacgagatcggcgaaaagtatcagattcagttcgccatcatgcacgacgtagccgagctgtacctcgatacctcgggcgccggtctgcacaagcgcggctaccgtgccaacagcaacgcggcgccgctccgtgagacgctggcggcggctatggtcaagctggcgcgctggcgcggacgcgacccgttcctcgacccgttctgcggctcgggaacgattgcgattgaggcggccatgatcgcgcagcgccgtgcgcccggtctgctgcgccgctttgatgcggagaagtggagctgctttgacaggtcggtctggcagcaggctcgcgagagtgcgctcgaccttgcccagccggacgctaaattcgatatcgtcggcagcgatatcgacccggactgtgtgcagctgtccatcgagaacgcgcgcaaggcgggtgtagccaacacggtgtttttcgagcgtgcggacgcgaccaagcgcgattacagcaatgcgggcgtactgtttgccaatccgccgtacggtgagcgtctgctggacttgcagcaggcggaaaagctgtacgccgacctcggcagagcgacgaaaaacagcccgatgaagcagtatctgctcagttcggacccgctgttcgagcgctgctacggccgcaaggcggataagcgccgcaagctgtataacggcatgatcaagtgcgagctgcatatgtattttaaagacccgtctgcatcgaacaggggagaaaataagcactccgaccatccgtctgctaaacggccggcaaaacgctgagcgctatagggcactgttcataatttgttcagaaaatttttgtgaaaattccggattacccccttgcatattgcggctccttggtgtaagataatactcgaagttagcactcgggtaatttgagtgctaacccccaacattgtaaaatcttatttttcataggaggaatccattatgaagctcaagcccctttgcgaccgtgtagttatcaagatggtcgaggcggaggagaccaccgcaagcggcattattcttaccgcatccgcacaggagaagccccaggttgctgaaatcatcgaagtaggcccgggcggcgttgttgacggcaaggaaatcaagatggaagttcagaagggccagaaggtcatcaccggcaagtacaccggcaccgaggttaagctggacggcgagaagtatatcatcgttcgtcagagcgacattctggcaatcgtagagtaattttcaggaggtaattcatcatggctaagcagcttatttacggcgaggacgcgcgcaaggctctgcagcgcggtattgatcagctcgctgataccgttaaggtaaccatcggtccgaagggccgcaatgttgtactggataagaagtacggcggtccgctgatcaccaacgacggtgttaccatcgctaaggagatcgagctggacgacgctttcgagaacatgggcgcacagcttgttaaggaagttgccaccaagaccaacgacatcgcaggcgacggcaccaccaccgctaccgttctggcgcaggctttcgttcgtgagggcctgaagaacgtagcagcaggtgcaaacccgatggtaatgcgccgtggtatctccaaggcagtcaaggctgctgttgcagcgattgctgagaactccaagaaggttgacggcacgaacgacatcgcccgtgtaggcgctatctcctccggctctgacgagatcggcaccctgatcgcagaggctatggagaaggtttccactgacggcgtaattaccgttgaggagtccaagaccgctgagacctactctgaggttgttgagggcatgcagttcgaccgcggttatatcaccccgtatatgtgcaccgacaccgagaagatggaagcaaatctggatgacgctctggtgctgatcaccgataagaagctgtccaacattcaggagctgctgccgatcctcgagcaggtcgttaaggccggcaagaagctgctgctcatcgctgaggacgttgagggcgaggctctgtccaccctgatcgtaaaccgtctgcgcggcaccttcacctgcgtagctgttaaggctccgggctttggcgatcgccgcaaggatatgctccgcgacatcgcaatcctgaccggcggtaccgtaatctctgaggaggttggtatcgagctgaaggacgctaccatggatatgctgggttctgcccgtcagatcaaggtaaccaaggagaacaccaccatcgttgacggtgctggcgacaagcaggctatcgcaaaccgcgttgctgagatccgcggcgcaatcgagcgcaccacctctgacttcgaccgtgagaagctgcaggagcgtctggctaagctggccggcggcgtagcagttatcaaggttggcgctgcaaccgagaccgagatgaaggagcagaagctccgcatcgaggatgcactgaacgcaacccgcgcagctgttgaggaaggcatcgtagcaggcggcggtgtagcttatgtaaacgctatcgcagcggttgaggctctggctgcagaggcaaccggcgatgagaagaccggtatgcagatcgttgcacgcggtctggaagcaccgatgaagcagatcgctgccaacgcaggcatcgagggcgcaatcgttgttgataaggtaaagcacgctgacaaggttggctacggctttgacgctgcaaccgagacctacggcgacatgatcgcaaacggcatcgttgacccgaccaaggtaaaccgttccgcactgcagaatgcagcatccgttgcttcgatggtcctgaccaccgagagcctgattgctgataagaaggagccggttccggctgctccggcagctccggatatgggcggcggtatgtactaagcagtaccccaaaacgctgaaaacactggggatttcaagggttcaaaggcaaacttaccataaacttacgacaatcgtcagtggaaaagcatcagatatgtacaaggccgacacctgcaaaatgcaggcgtcggcctttttccgttgtcgaaaaatacagatgcaaatgtgcttaatggattcttcaagaggcttgagacttacccggaaatgaaaacagagcgcttcacagcagtgaaacgctctgtttttgtatgagtatcatcggatttgcgtgcgccggagctttatgcagccattgctcagaaatccggatgaagcagttccgcggcagccggagattattcgtacagcgggaacttctcggtgagtgccagaacgcgtgcggaaatctcgtccttcttctcatcgtagtggtagatgcagtctgcaatgcagtccgcgatgaccttcatctcttccacacccatgccgcgggtcgtagcggccggggtgcccagacgaacgccggaggtgatgaacgggctgcgcttctcacccggaacggtgttcttgttggcggtgatgtgaaccgaatccagacgcgcctccagatctttgccggtgcactcctcgtcggtcagatcaacgagcagcaggtgattgtcggtgccgccggaaaccagcttgacaccgcgtgcctgcagctgtgcagccatagccttggcattctcgacaatcttgcgtgcgtactccttgaactccggctgcagtgcctcgccgaagcaaaccgccttggacgcgataacatgctcgagcggaccgccctgggtgcccgggaatacagcggagttaatgcgctttgccagaaccgcgttgttggtcaggatcaggccgccgcgcggaccgcgaagcgtcttgtgggtggtggtggtaacaacgtcagcatacggcatcgggttctggtgctgaccgccggcaaccagaccggcaatgtgcgccatatcgaccatcaggtaagcgccgtagccatgtgcgatctcggccattttctcgaagtcgatggcacgcggatacgcggatgcacctgcaacgatcagcttcgggcgatgcttcttgacagccttctcaagctcagcgtagtcgatgaagccatcctcgtttacgccgtaggaaacaaagtggtagttcttgccggactggttgaccggagagccgtggctcaggtgaccgccctgagacagatccatacccataacagtgtcgcccagatcgagcagagcaaagtaaaccgcaaggttggcctgtgcaccggagtgcggctgaacattcgcatactttgcaccgaacagctcacatgcgcgctcgattgcgatgcgctctaccttgtcaacaaattcacagccgccgtagtagcgcttgccgggaagaccctcagcgtacttattggtcagcacgctgcccatagcagccataacgccgggagaaacgatattttcgctggcgatcagctcgatattctggcgctgacggtgcagctcctcgttcatcgcactgcccagctcggggtcgatcgactggatcataccgatggaatccatcatttctttgtacatttgaactacctccaagctttagtagtataaagttctctttgactataccattgccctcataaaaaagcaagtcgattttacgaaaaatataaccaaagatgaaggattgtaaaaagcctcctgcaaaaataaaaaaggcaggttaccctgcctttgctcagatgttctgatagaacagtccgtccctcgtgcagtaccacagcagcatgccgtgccgaatatagggcagacgcacgtctaatccccattccgggtactgctttttgacgatcatcgtgtctccggtgagaaatgccacgaacgagatatagtgctcgcggtgcatttcatgcggtgcggtgatataccattcgccgtcgctgtgctcaatttgcagtgcattttcctcgtccggtttgtgcataacgaggttggtcaattttgcaccgcagcaggtcacgtctgcgtcatcggtcgagaacagcaggttgccgcaggccggacagcggtaaaaccgcattttcttcatattgccgttagtcatatcgttttcctccagatcgcctctcagcagggcttcggtgtccacgccgagggcctgtgataacaatgggaggagcgagatatcgggagcaccgccgcccgtttcccttaattaaagatattgttgggtaaaaaaagaaaggtcagtcgattttgccgatgaagcggtagtagatttctacttcctgctcacgacttccgtcctcgcccttgacagcttcgtggacggttattttttcaattagagtgttcagaagttcggcggtcagctccacagggttgacatactgtttcattagggcaatccacttttcagcatccgctgcggtctgtacggcggcttccatcatttcgtgaagctgtcttatttttgtttcaagctccttttgctcgttctggtacttctcggacagcatattgaaattatactcggttatgcgtccggcagaccagtcctcatacattttagcaaacagcccgtcaacctcggctttacgcttttccgcctttttcagctccgcagcctgctttttcttcgcagagtttctttctctgtcgctggcattgagcagccgtttcagcagcttgtcctcgtctttctgtgccaacatagaccagtattgcagtcttgcaagcacataggcatacagtacatcataacggatatagtgcatggaacactggcgtaatccctgtccgttcttgctgcaatggtagtacccgtatgggttcttattctgcttgttttccccataggctaaagaccatccgcagtctgcacattttatcaatcctgcgaaaatctgtgttgtaccatttctgcgtttcctgcgtctgcttgcaatcagctcctgaactttttggaacacttcttcggaaatgatggcttcgtgggtattttccacacgataccattcttcctgcggcttccgcacttttttcttgttcttgaatgaaatgttgctctgcttgttgtgaacgctgtgaccgatgtaagtttcctctttcaaaatgctcttgacctgtgcaatcgtccacgcataggctttttctgcgggcgcaccggcgtagatattggcgaaagtcccatatctttcatagttcagccagccgggggtaggtactttttcttccaccagaatccgtgtaatgctggcggcacccctcccgtgtacggcaaggtcaaaaatcttttctacaatccagcgtgtttccgggtcgatcagaagatgaccttttttgtccgggtcttttacatagcccagcggtgcataggctccatagtgtgcgccattggcaaatcttgtgtgcatggcagccttgacctttttgctggtctgtcgggcgtgcatttcattcaggatgtttaagaacggtgcaagctcgctttctccgttgatggtgtccacattgtcattgatggcaatgtagcgtactcccttgctggggaaatagatttccgtgtactgaccggtcaggatatagtttcttcccagacgggataagtcctttgtgacaacgcagttgattttcccgtcctcgatgtcatcaatcatcctttggaaacttggacgctcgaaatttgtcccactccatccgtcgtcaatgtactcgtctacaacggtcagcccatgctctgcggcatactgcctaagcatcatgcgctgggtctggatgctgccgctttccccctgtaattcatcgtcacggctcaatctcaaataaagtgcggtgttataaatcgttgtattgtatggttgtttcacggttaaaaatcctccttctaaaagaaacaacccacgcttatacaatactcgctggtacaagtatatcataagcgtgggctgattgacagtcgttattccgtattttttcaggaagcggcggcagcgtgctggatcacatcttccagcaggctgtcaagcggcttcccatcctgtgcgaaatgctccgataccttgatacggactttccccatgacaaaatactgggtgccgtctttttcggtaagcagggtgccgctgtttttgttattgctctcgtttttgctttttgccataggcagttacctccataaatgaaatatgcccgacaagggaatgtcaggcaggtgtacagccgcagactgtctccatgtcaaccgaaccgtgtcaaccggcagaaaagactttgaaaacaatccataggcgctctatgattactttttactttttctttgatttcttggttgacatggttgacaaaggagagaaatgccccaaatatcaggcttttccccgtcaaccggctgtcaaccgaagcgtcaaccaaactgttaaccggcggcttttcagaatggcagttccatttgccgggcttcttcttccgtgatttccttaaaaccgtccccctccggcggggcttggttgacacgctcccagcctttttgagaaccgtatttcttataccgcttcgggcttttgtaggctgcccagccctgtatgatgccgcccgcaatgccagtattcataatctcgcagattgcccgtgtctcccagtctgccggggaatttaagttccccagcgcttcctcataaagctgtttggagcataccctgtcaccggtgtagtcctccaaataggcgtagatcatgccagcttgtgtgtcctcctgcatgaagtcctgctggtgggcgttcaggtatcggttcatttctatgctgaatgacagcttatacttcccactgcggtaaaccgtcatggcttccgcccacatctgttcgatatacgccctcgccgccgcttcatcatccagtatgtgaacctccgcccgttccgggtacaccgtcacggggagaaagcgccggttgccggtgcggtcacggggtaaaaagtcctgccggttggtcgtccctccgaatacacattgccgcagccggtctgccgggtgtgtctcatacggcactttgtaggtttctttctggcggcttaagaatgacttgatttcctcaatactcttggcgttggctgtggcgatcatctccgacatctcgataatccaatgcccttgcagcttgcggtacacattttcatcgtccagcttcttcaaatcgtctgaaaaccattcgtccctgcctgccagcagccggaaaaaggtagatttcccggctccctgaccaccaaccagacagagcatgacctcaaacttgctccccggtctgaatacccgccggatggctcccatcaggaacagtttcaaggcttcataggtgtattcgtccgtatcggctcccagaaagtgatgcagggcgtaacggatgcgctctgtgccgtcccattgcaggctgttcaggtaatccctgactggatggtagcggttttcattggcaacaatcttgatggcgctctgcacctttttctcgctggtaagcccgtagttttcttccagatacaaaagcaggtagtttatgtccatgtcggtcagcgtggtactggtgcgctcccagcccagcggcttcacaatgtcaatctgctccgtcaaaaggttcaggcgcagcgccccgcgaaacagagggtcacgctggaacaccgtcaggcagtttcggatgctgttcttcacgccgcctttctgcgtcccctctaatgtttcccggatttctgccggtgtttgcgccggttccattgtgtccatcgtccttttgaccacttcctgcgtttccggcggcaagctctgaaattcgctgttcaagccgcagcacctcctttccctgtgcggcgatcaatgccgctttttcttctatttctccgtataacaaaatatccaaaaggtattctgtgtagcttatcctctgcaacgcttccacaaaaagaggatgccagatggcatcctgcggctgtggggcgtatgctgttttccaatgctccagcaggcgcagataatcgcatagcacccggaaacaataccgttccgtttcctgaaatctctgctccgctgatttttgtcggggctgtgacctgttgtgacgcttcctatctggcggtgcattgccgggtttctcataggaaacgccgaagtccttcgcaagcctgaccgcagcttcccgtttccccaatccatgcagcaaagcggcaaagtcgatcacatccccggaagccccgcagccgaagcagtaaaagcggctgtccactttcatgctgggcgtgcggtcattgtggaatggacagcagaccatgccgtttctccccacccggattccatagaatgaagcagcctgccgggtggtaacagactgtttcaccgcttcaaatacattcaaatgctccctccataaaaataccggcagcggtaaagctgccggttatatcatagctccatctcatgtttctttctctgtacttcctgtggctgctccctccggcgcagtgcggtatctacggcgttctgcacctgccgcagccgtatgacttcctcccggagtggcttgtgctgcggagacagttcggcatactctgtttttaactgtgcatattcctgtttccatgctttcagggcaatgggttttccgtccagtttttctttcagaatacggcgggcggcataaaacagccgtaactccgcatcgtgggatgtttcaaatttctccctctgtttcttaaacttgatattgttcaattccgtatgaacaggttttagccgctggtaattctcgccctcccgtatcaattcctgcaattcctttatcctggcagatttctttttcatggagccgcttaatgcttcaaattcttcactgacagaggaaagacgctcctgcaaatcctctaatgtgagcagcttgttttccgtcagataattgacggtttcgacaaactgctttaagtttccggttctggctttattgctccatgcccctgcgttgcgctggttgtaataagcgatcagcaggtcggcaaggctcggtgtctgcggtttggaaagttcttcttttacctctgccatccagacaaacagggctttgatcttcttcctcacatcctgcatgagccggttggtggctttaatccagcggttcagttcccctttctcggtgcggatgccctttgcttccatctgccggacattagctccctcgtggacagtaggtatcaggtcaagcccctgccgcacataggaacggtggtcgatacgcacatccagccctttttcctcaaattttgtattaacggcagccgcccactgctcccgccagtgttccagcgtttccggctcatgccagtctgttgtatggacagcgttaaacatataatcgccgtttttatcccggattcggtttccatcttcatcaagaagatattcccgccgctgtttttgtccccatgtgccatccgggttcaaagggcgcatggttgtcatcacatggaaatgcgggttagggataccgccgtcctctttctccgggctgtgaaaagcaagatcggcaatcatgccttttgccacaaactgctcctgcacgaacttcctcgccagttccatgttttcttccagcgtcaattcattctgcatggcaatatcaaaggaataggcaagctgtgcttttggatgtttctcgcagctctccacagcattccagagggtcgcccggtcaagatatatttccggcgcatggggcggcagcatgatttccgaagcgatcacgccgccctttttggtgtaatcgctgacttctccatagtagctgctgtaaagacgctccccggctcggtaggctgcgctggcaatggcgctctgaccggcgctacgctttatctgtgcgattgaaaaatgataaagtgctatccttagtcaccgcctttctcctgcccggaaatacgggcgtggttttctacggcagaccggatgaaatgctccgcctgcggcagattcaaaatgctttccatgagggaataaaattccgcttcggatagctcctttgtctgtggtgcaatgctctcaatagctgccccacgggtaatcagccggtgcgtcctctgtttccgggaaccgctttccagatacgcctgccggtttttcaaacgctgcattttccgtttttcccgttccagcaggacagtggttttttcatattcctgcttcaactgttccaaagatttttccatgttctcacatcctttgcttataagataaagaaagaccatccgcagacagtctgtgtgtcagtgcttctataaaacccgatgaaaagggaaaaacgcagagcggatttctcttttcggcgggtacacaggggatagccgctttagcggcgcaagggggtgtagccaccttgtcggagcgaagcgaacgcagacctcggattgctgattttatcagcggcagaggtaagctccgcaggacgcacgatacatggtctttagactatgtatagaagtgcgcccttagttcctaatggattttgccgtttccggcagtcttgtcctttttcttggaacgcttggaaagatacttcgggcagtcaaccacaaccgcccggaagctctgtttacattcgtgctggcatttccggcacagttcgttgtaagtgatacggctgcggtcatttaagaagaaagaccattccaaccgccgcttgttactcattcttgccataaccggctcctttctccgtttctatctgatgtacgcagataggctgttttgatgtagcgtctcggtatcatttttaagtttttttccctctgtatgcccctttggaaagtgcggcagtattgcaagtcagggaatgatacctcacgcttatttgtcgcttcccggtacggtttcggagccttttgccatccattcaaagaaagcaattttgctgaccttgataagtctgcccctgcggaacgctggaaagccgggtgtgtgtaccagctcataggcgctcgctcttgaaattcccataatccgctgaatgtccgccacatccagaaccagcggtaaatcctcgtagctgttcaatctctttttatcgttcattctgttcctcccataaatcaaataggttaaaatgcttcctgttgccgttctccccaaaagccgttttcctgccccattcctgcggtgtttccctgcattggtgcgccgaatgcgtcacttctcctgccggtcatatcccttttggacggtcattcacttgtcaaggtactgtgcggtacgaaattaccaaccgcaatcatcatagcgtactatccttgacaaaacaatgattctgcgataccatgagtgtaacggatataactgaattatataattaccataaacaaaggcaggggatagggatggagaatcagtttatacggcatgagccatgttttgagaggattttgtttgtcctgacgctggacaggaagaaaatgaaagagcggattttgattggggaagaacagcagatccgcttccgtctgaacgggagccaaaacgcagaggtgctttgtgatatgacacgcccactgggaacttttttgataaactttgagcgtgacacggacagagactggaacttatacgggctttctccgctgcggcaagctctccactccaaccgatggaaacagccggagctggagcaggcggcaagcgaatttctttgggagaaatatcttagcaacgaccctctgaaaatgtatgtggcgttccgtatctggaacagctatctgcttgccagagaaccccgtgaccgtaacgctgcctgtgaccgcttcatggataaaatgagcagactgaccggggtattccaaaacgaaaccatgagctttgacagggagacaggaaaaccgaaacaatttcaagctggcagcctttatttcaaaggcgcaccgtcagaagatacccggcttgacctctggttcccggacaaccggcgcacagaagaatgtgtgtctgcctatgcgtccctctacccgttgattacctattatctgaacaggctgaatgactgggggctttgcttccggcggtgcaaggtctgtggaaaatattttctggcaaagagccagcggtatgagctgtgcagcgacaagtgccgaaaagcacaggcgcttcaaaacaagcgggaatttgacgagaggtcaagagaaaataactatgacctgctttataaaaatgaatgccagaactggcgcaacaaaataaaccgggtaaaaaataccgcaggctttccggctgaccgtctggaaaaaatacaggctgccttttccgactttaagaaagaagcattgcagagaaaaaaggctgtaaaaacaggaacagccagcccgaaagaatttacggactggctgtatcagcagagtaatgtaattgtggagctgactgaatactaatttttttctcgttgtgaggtttctgtgacatttgcctgatggcagtatcgaaattgcagtaattactcatgcaaaatgcttcttcgttttatacactatacctatatggtggagcaccaaatgaaaggagcaaaaaatatgtctgcaattcaaaatgcgattgaagtgaggaacttaacaaaggtttttagtggcagggttttgtttgagaattttagcctgaatgtaaaagcaaatactattcatgcgattattggcccgaacggttctggaaagaccacactgctgcgcttgattacaggggtataccagccaaatgcagggacaatcaacattgcagggaaatatgcaatgcagcttgaaaatgactatctgtatgacgaaaagactggccttgaaaatttgaaaatttttggaaaatactttggatttgaaataaatgatcgttcagacggctattgtacgcaattaggattgaccgagcatttaggaaagcgtgttagcacttattctaaaggaatgaaaagaaaactgtcccttttgattgtgattatgatgggacgggatattctgctcatggatgaaccaacatcgggtgtagaccccatatccagagtagaaatccgtagtttgatagaggctctaaaagctgacggaaaaacggttattatcacttcacatgaccttagcgagattgaaaagtgcgctgatgatgtatctatgaaaaaatggcagattgctgtttgataagggtattcaagaaatgcaaggacaatcattggaagaaatctttattaaggagggcaatcggcatgagtaacatgggaaaaggcgcaggctactatcttaccagaagtaatagcctcctaattgatactgcgattgttgccattctggcgatttttatgagctttgcaatgcagatggacgccttgcagtctaagggagaagattatttagtcctaatgctctatgcggttatttttggtcttacctccctgcaatccggtgctatgattgtagatttgacagcaaaggataaggtaagccggagaattgaatttttgcagcttctggaattgcggtaaaagagattataaaacagtattcgatacagattttccgcttttctggtattatcccgttctttgtttttatgagttgctattactttaccgactggacaatgagctttgggcggatcgtatgcgtttatcttagtattcttgtacttagtttttgtgagattgtcgctttgaatatcattgtactggatgtgaaacgagtaaaactgttcaaaaatgttctattctttggtaattttgcactggtttatttgattgcgatgtcggcagaacgaattacagagtttgtgaatcaacatcatataggaattgactatttgattattgtggttgatgttgcactttgcatgatgtttgcactattaagtttctttaaggctcggcacatgagcaacgaagcagttatcaggagggatggcgaatgggtttgataaccttaaaccttaaaagggtattgaactggaattttatatttatgagtgcggtagcagctatcttcggcatgatctctctgatgaactttggggatatttcagagaacattgtatttggcgttgatataaagtattttatgcttgatggatacctgtgcttatttatcttttttgccggagaaataagcaaggatatgttgcagcaagaaaaaatcacaaagagaatagaatggaaacttgctaatggtattaaaatctcaagtattgttaaagagaatctgctatcacgcactactgaagattcttctgagattagagatttagatttttattccgctattggtgtcaatggtaaaaaaggatatattcgagcaagtgaaatgaatgggccgaaaacgcttgatgaagccgcgacttatgacgatagcagtaaagatattcctgtatatgcatctgatggtgtcacggtcattgatactttccatatttatggacccgaagaaagttcctcgactgatactatggttgcagctacttcgttaacggaataaattacaaattttaagattaggtaaaatagcatagaaaggagcatttttatgaggtctaagaagaatatgattaaacgtttagtatcgttgctgttatgtagtgctatttgcgttgttgcggcagctgcagcagataattggcagtattctaaatggacagcaaccgtgacgggtgtaagcaatattaaatatcatggaagaacagcgataactgcttctaagggattggttcgttctacagcgacaattttgagtactaatacttcagcgttgccggcaggatatgttaaggctaaagcagaactatatcgcggaccggcattagcttcgtatggtggacctgtatcgaattccgcatcgagtacaggcgttactgcaagcacgggacaagcaagtggtgcgggaacttataccgcgcagggaactacatattatgcgacaagtagtaatagggatatggagactcttgaactggaaagtgtagattacaaaacgttggttcgagctaatggcggaaagaatttaaccagcgaacaaaaagagattcatacgaattctgctggagaaacttacggggaagcaatggttgtaaagtatctgaaagcagatgtagatctcatttctgccgttggaaaaaatggagtagagggctacattaaaacatcggatcttccgcataatattccggattatgttccgtatgaccatgagattccgatctatgaaaatgatggagttactgtgattgattcgtttttcatttcttctggatatgcaaactaggtagaatagtcagagtattgaatgtgtgacaaatagaaagaagctcttgatgggcttctttctatttgtataagttgattactgtgtttttttcctatctgtaaagagaaacagggcggtgattactatgctgcctatatcgtacattccgaaaaacgagcgtcaagggtggttcacacaaaccacttttttctacccgttgtacgccgatctgctgcgcagacggctcgaacggggcgaaaaaagcaagcccttgacgctcgtttttctccatgtgccgcagcaggcagaaggataatctgctgcactggggcttgctaccgcaagcccatctcccacacttgacaacgatatgccagatatgtataatgagggtgtgtgagatatattgcaagctacctaaagtgttaccactttagagcttgtgagggggctgcacccccttcaatcccctgattggagaacgccgcgaacgaaagaaagagaggtttcccatgttgtacgaagatcggaaaaaagaaatcgaaaccatcaaggaacggacactcgttttgaaattgtccgatgctgattgcgaccgcattttgcaaaaagcagccagccacggcatgacggtttctgagttgttggagagcttcatcagtgatctggtcgatggtactttcaccaatggttcggacgaacgctatcttgctgaggattggttcaaccgctgcggttttgagcgtgatgataagagaacgctgctgtggcatttgctggagcagaacgcagacctcgaaaattttatcgaactctatgaggagaacgaagaatacaaatcgcacccagaggagtttgaggagcagcgtgaagaatacgaaatggagccgggagcaacgttctggtttgaggaagaattgcagtattgtctggacgattggaagccgagcaagttgagcatggccgaagaagtagaagctgtccgcggctatgtacaggcaatgaaaaacttcaagggagaataactgcggtggcaaataagagtagaccgaagcagctctcattccgagttagtgaggaggaatgggagctgctgcaacagaaaatttctgaaagcggtatgaaccagcaaaggtatattttatcctgtgtattggggaagaaaatcgtgaatacagacggcattttagccatcatgccagaattaagacggcaaggcgtgaacctaaatcagattgctcaaagacttaatgagcgtggttatattgactataaaaaagaactgtcaacagtactgaatgaggtgaataatgtatggcggttattaaagccgtatcttccagagctggaataaagacaattcttaattatgtgatgaaagaagaaaaaacagagaaaaagttacttagttgcttaaattgcacaccagacatggttcaagaacaaatggaatttacaaaacgtctatgggggaaaaatggtgggcgaacgtataaacattttgttcaaagttttgcaccggaggaaaatatagatccggtgcaggcgcaccagatcgcgtgccagttggcggcttcacgcccagagtggcaggactttgaggtgctgattgccacccacgaggacaagaagcacatacatacgcatttcgtagtgaacagcgtgagttgcgtagacggccacaagattcagcagagcaaggcggagctacaggccatgaaagattattctgaccagctgtgtgcgaaatatgggctgcatattaccgaaaagggaaagacctttgacggacaagagcgagaggaaacggcagcattcagcaaggacacatatcagttgctcataaaggccgagcagggagaagtaaaaagctacgtgcaggacattgcgctggcaatactgaagtgtcgagaacaagcgaccagtcgcgccgattttgtgcagcatatgaatgagcaagggtatggtgtggattggcaagatagccataaatacattacctttatagacttaaatcgccaagtaaaaggtgaaaaacagtgcaaaattcgcaataataagctggaaaaatactataatatgaatttcggaaaggagacattggagcatgagtttgcaagcaatgcacgaacagcagaaacgccaagagagcagttcaatcgaacggcttcaagcggagaattcgagactttcatcgcaaatcttgcgcttacagagcgagctgcagcagcgaagtcaagagatagtgtcgctcaacgagaagatcgggaacatcgagcaagagagcagctcgcagcttgtcgaagagcagatgaaggagatcgagagacagaaaaagatcaacgcggagttagagaagatagcagaagacgcctcgaaagagatagagggattggaaaaggaaaacgaaagacaactgaaaaccataaaagaagcagcagagacattcttgaaatatagtaacctatacaaaaaattagtgccatgcgaagtgatgggcttaatagatagggtgaacaatctcgaagtagaggctacgatctttggcggtgtcaaaggcttgaagatggaacagtgggaaaaaataaaagagagcgtcaaaagcatatcagaagctttgagccaagatccgatactaaaaaaagaaatggaaaatcaaatgaaaatcattgatccaccaaagggtatacgtgcaagaattgcagagaatgaaaataataaaaggaagtgatacgaatggatgaaatgacaaccgcagagcgcaaccagtatcttgagaacatcgccaagctgattgaaacgaccgcagaggacgctgcctctgccgcacagattgtgcgtgacagcatggcgtcagaggaagatactgaggaattggatgagatgacaggcaaagagattgccaggctgatggaatggctgaaagcccatgggcatacatcggacgagatcgtctcctgcgtcgagtacaccgttacttgaggtaaaggactcccgagggattaggctttcctcgggagtcctttattcgtccagagacttgacgctgtgcgcggtatgagatacactaagaacaggcgaaaatggtcgaatgagcgcccgctttttttgtcgggaaatggtgaaaaaaaattcattgataatataacgcccctaatagggggcgaggggatggtagagggtagctggatcggagtcggactaccttgaaaattcgggcaagtagcgtgcccaattttttgtcgggaaatggtgaaaaaaaattcattgataatataacgcccctaataggggggcgaggggtctggaggagaatggtatgtttgatattgtagcggcgttggagtcgcagtttgacgaggtgcattacttagatttttatcgggatatcttcccggaaggctcgttcgaggagcgcggtgtctatgaggacgggaagtacaatggtattgccgttaccatttcgaaaggtagcaagcgagcaaaacgcctgacagttaccgatgatcttgacgcgattactgatatggcagcgtccgatgatttttgtttaatgagccctataagctatgtcggaaagagtcgaaaatcctcgaatgctcggtttatgtacgcaatgaccatagatttggatgggttagagagcttgatacagtggcagcagcttatggatcagattgctcgggagcctggtgtgctggtaggaggttggggattgccacgtccgacctatctcatttcatcggggacaggacttcacctgtactatgtctttgaaaagccgatcccgatgtttaagaacattgtggaacagttagagaagttgaaaaagcgtattacttggcaggcttggacgcagggcgcgtcatcattgcatgacaaggtgcagtatgagagcctgtttcagggtttccgcgtggttggtacgattacgaaagacggtggtcgctgccgcgcgttctcagtagggaggaaggtgacggttgagtatctgaaccagtttgttccggaagagtatcgagcaacaaatttcgtttataagtcggatttgcggttggaagacgcgaagaagaagtatccggagtggtatcagcgacgtgttgtagaaaagcgtccaaagaatacatggacatgcaagaaggcgttgtacgattggtggattggaaaaatctatgggggtgctgaccagggacatcggtattggtgtattatgacgcttgcgacatatgccagtaagtgtggtgtaccgcgagaaacgctcgagaatgacgcatacgggcttattccttttatgaatacaaaaggtgatgcctttaccgaagacgatgttctgcacgctctggaggcttatacggacagctatattacatatccgattgatacgattgtcgtgcggacaggtattcctattgagaagaataagcggaatggtagaaaacaagccgatcatgttaaactgatgaattttatacgcgatgagattaacggtaataaaaattggcgtgaaggcaatggtagacccagcaaacaggatattgtagaagaatggcaatgccagaacccaaatggcactaaaaagcagtgtaaagatcaaacggggctatcgtatccaacaattcgtaaatggtggctggatcatagcgaaatatttcctttgtatggggaaggtgatgaaattattagatatgtgaccaaaagaattgtggaggagtacaaccggttaggtgtgaaaacaagaggggagaataagcgtatggatatgacattggcacagcaggcagcagaattgagaaagtttacgaggacaggggcaatgctgagcttatcagagtccgagcggcgtgaaaaggcgcaggaactgatggatttagctgaaaagattgcatatagtgaaggaatatcggaggaagaggcgtataatcggtatttgaaatacagaccgagagatgagcggttgcaggagcaggcaaaacagatggtttttgcagagagcgaggtcgatgcaggtttgctggctgggtgtgctgcgaacggtatccgagagatcagcgttatgccggacgatgagtacatgaactatttagcgacagattgcgttgacgctttgttcccaccgaagaacggaaatcagataaaataaatatcgcaaagcacttgcaatgcaaataataatagcgtatactgtaagcagaaaatataggcgatacatttttgagaggagtgttttcacatggcaactaagggaaatatgacgttgcgcattgagccggagctgaagaaagaagcagcggcgttatttcagtcgcttggattggacttgagcaccgctacgggtattttctatcgtcaggcattgcgttatcatggtctgccgtttgagattcgtctggatgagccgaacgccgagacgagagaggctattgatgaagtccagagaatgaagaaagatcctgcaatcggcaaaacttacactgatgttgatgccatgatgaaggagttgctggcatgaagtacagtgtacgcccgaccacgaaatttcagaaagatctgaaacgagtgcagcggagaggatatgatttgtctttgctgacggacatcatcaaaaaactcgcggaaggtgaaaccctgccagagaggaacaaggatcaccgtttggctggcgattattctggttgcagggaatgtcatatcacgccagactggttgctgatctatgaggtggcagacggcgagttgttcctttatctcaccagaacggggacgcacagcgacttgttctaagaggagtggtgtgccggatggcaaagacgatcaaggaaattgcggcagaatgtaaggtgtctgaacaggcaattcgcgggtggtgtcggcgaaaccatgttgcgaaagatgcgaaaggaagtttcgcaattagcgaaagccaaaaacgcaagctatatctacactatttgggggtagcgcgaaacgaagttgcgaaacctgcgaaagcaagttgcgaaacttgcgaaacctctgaaacagtgctgatttcaatgttgcagaaagaattagaccgcaaggacgcgcagctttctgcgaaagacgagcagatcagagagttaaacgcgaggttggctgagtgcagcactgcattgttggcagcgcaggaaactgcgcgtgcggcgcaggccctccacgctgggacaatccagcagcagctttccgatggggaagatcgtgtagcggccagtgtgcctgaggagcaggctgcaccgaataagcggcgctggttcaatcggttctttcggagataatggctgtaagcaatgataataagccctggtgtagcacaaaacgccagggcttttgctgtatgtgttttggacatttagagtggttgatatttacatattttaatggagattgtattataataggtgaaatttagagaattgcatgagatgcaatctataattgctcaaatgcaatcgtagattggtttattttagtcgaatatgtgggtaatatagaggtgtaataaatgactacagcagagaagttagttagcttgagaaaggagaaaggtttatctcagcttcagctggctgaggagattaatgtatctcgtcaggctatatcaaggtgggaagtcggattagccgttccctctcgggagaaactcagagcattgagtgagctgtataatgtatccgtggattatttgctatcggataaaacggctgaagatatgcaaaaagtttctaaaccggaagatgaagcaaaagaaaaaccgtcaaaccatttacgggtgggcctaatggcttgcgttgtagttatattgctggttgtggtgggtgttatgctgctgcatttacataacactaataagccgcaaaatgaaattccaatttccgaaatggaaacagaagaagatgatgttgtattttctggagatttttcggtagattggtaggcgtttgtgaaaggaagtggtagcaatgggagttaagaaaattttcggctctattttggcaggagtgctcatcgttagcggggtgggtatgtcagctaatgcagctgatattgctccgaaaaacgttgagcatcgagatcgtgtaattgaacagagtcttgaacgtgcttcagggtcctttaatatgacggttcctgctaaatctatcttgcgggcagataagagtttcccgttggaagcaggggaaactgtaacgattaaagctacatactttccattctctgcaagcgtagattttggtttggttgatagcaaagggaaatttcattatttaaccgtgaataatggcacttttgataagaccattaaggttgatactcgtggcaattatgtatttgcagtgagaaacaattcctcacagagtatttcggttagtggttatgtaaaatactgagtttatagactatagaggtgtctttatgaaaaaaaagcgaattggaataattgcgttaatgctttcaagtgcgctcatcatttctgcatcggctaccattagcactgctttcaagtgctcggcggcgggaattgattatcaggcatattcgacattaaatacgtcaagcactgcacctaataaattagctggaggaggaacagtagcaactgtaagcaaaaatactgtgccagctggctatatgatgattaagtctacaattatgacttcgaagggtgaagtagtaggcagctctagttggactcaaaatacacaatatgcgaataatttggtttctaacattagctatgcttcttatggaacaggaacatattacggacaagcccttctgaaactttacgaaggtggagagtataaaccactgacagttaccagaactccatcaatggcaaagccaactcgttcgtctatggcgaataataatcaggaaacacaagataaagatgctattttcgtaaatgagaatggctatacaatgggtaatgccactactgaagattcttctgagattagagatttagatttttattccgctattggtgtcaatggtaaaaaaggatatattcgagcaagtgaaatgaatgggccgaaaacgcttgatgaagccgcgacttatgacgatagcagtaaagatattcctgtatatgcatctgatggtgtcacggtcattgatactttccatatttatggacccgaagaaagttcctcgactgatactatggttgcagctacttcgttaacggaataaattacaaattttaagattaggtaaaatagcatagaaaggagcatttttatgaggtctaagaagaatatgattaaacgtttagtatcgttgctgttatgtagtgctatttgcgttgttgcggcagctgcagcagataattggcagtattctaaatggacagcaaccgtgacgggtgtaagcaatattaaatatcatggaagaacagcgataactgcttctaagggattggttcgttctacagcgacaattttgagtactaatacttcagcgttgccggcaggatatgttaaggctaaagcagaactatatcgcggaccggcattagcttcgtatggtggacctgtatcgaattccgcatcgagtacaggcgttactgcaagcacgggacaagcaagtggtgcgggaacttataccgcgcagggaactacatattatgcgacaagtagtaatagggatatggagactcttgaactggaaagtgtagattacaaaacgttggttcgagctaatggcggaaagaatttaaccagcgaacaaaaagagattcatacgaattctgctggagaaacttacggggaagcaatggttgtaaagtatctgaaagcagatgtagatctcatttctgccgttggaaaaaatggagtagagggctacattaaaacatcggatcttccgcataatattccggattatgttccgtatgaccatgagattccgatctatgaaaatgatggagttactgtgattgattcgtttttcatttcttctggatatgcaaactaggtagaatagtcagagtattgaatgtgtgacaaatagaaagaagctcttgatgggcttctttctatttgtataagttgattactgtgtttttttcctatctgtaaagagaaacagggcggtgattactatgctgcctatatcgtacattccgaaaaacgagcgtcaagggtggttcacacaaaccacttttttctacccgttgtacgccgatctgctgcgcagacggctcgaacggggcgaaaaaagcaagcccttgacgctcgtttttctccatgtgccgcagcaggcagaaggataatctgctgcactggggcttgctaccgcaagcccatctcccacacttgacaacgatatgccagatatgtataatgagggtgtgtgagatatattgcaagctacctaaagtgttaccactttagagcttgtgagggggctgcacccccttcaatcccctgattggagaacgccgcgaacgaaagaaagagaggtttcccatgttgtacgaagatcggaaaaaagaaatcgaaaccatcaaggaacggacactcgttttgaaattgtccgatgctgattgcgaccgcattttgcaaaaagcagccagccacggcatgacggtttctgagttgttggagagcttcatcagtgatctggtcgatggtactttcaccaatggttcggacgaacgctatcttgctgaggattggttcaaccgctgcggttttgagcgtgatgataagagaacgctgctgtggcatttgctggagcagaacgcagacctcgaaaattttatcgaactctatgaggagaacgaagaatacaaatcgcacccagaggagtttgaggagcagcgtgaagaatacgaaatggagccgggagcaacgttctggtttgaggaagaattgcagtattgtctggacgattggaagccgagcaagttgagcatggccgaagaagtagaagctgtccgcggctatgtacaggcaatgaaaaacttcaagggagaataactgcggtggcaaataagagtagaccgaagcagctctcattccgagttagtgaggaggaatgggagctgctgcaacagaaaatttctgaaagcggtatgaaccagcaaaggtatattttatcctgtgtattggggaagaaaatcgtgaatacagacggcattttagccatcatgccagaattaagacggcaaggcgtgaacctaaatcagattgctcaaagacttaatgagcgtggttatattgactataaaaaagaactgtcaacagtactgaatgaggtgaataatgtatggcggttattaaagccgtatcttccagagctggaataaagacaattcttaattatgtgatgaaagaagaaaaaacagagaaaaagttacttagttgcttaaattgcacaccagacatggttcaagaacaaatggaatttacaaaacgtctatgggggaaaaatggtgggcgaacgtataaacattttgttcaaagttttgcaccggaggaaaatatagatccggtgcaggcgcaccagatcgcgtgccagttggcggcttcacgcccagagtggcaggactttgaggtgctgattgccacccacgaggacaagaagcacatacatacgcatttcgtagtgaacagcgtgagttgcgtagacggccacaagattcagcagagcaaggcggagctacaggccatgaaagattattctgaccagctgtgtgcgaaatatgggctgcatattaccgaaaagggaaagacctttgacggacaagagcgagaggaaacggcagcattcagcaaggacacatatcagttgctcataaaggccgagcagggagaagtaaaaagctacgtgcaggacattgcgctggcaatactgaagtgtcgagaacaagcgaccagtcgcgccgattttgtgcagcatatgaatgagcaagggtatggtgtggattggcaagatagccataaatacattacctttatagacttaaatcgccaagtaaaaggtgaaaaacagtgcaaaattcgcaataataagctggaaaaatactataatatgaatttcggaaaggagacattggagcatgagtttgcaagcaatgcacgaacagcagaaacgccaagagagcagttcaatcgaacggcttcaagcggagaattcgagactttcatcgcaaatcttgcgcttacagagcgagctgcagcagcgaagtcaagagatagtgtcgctcaacgagaagatcgggaacatcgagcaagagagcagctcgcagcttgtcgaagagcagatgaaggagatcgagagacagaaaaagatcaacgcggagttagagaagatagcagaagacgcctcgaaagagatagagggattggaaaaggaaaacgaaagacaactgaaaaccataaaagaagcagcagagacattcttgaaatatagtaacctatacaaaaaattagtgccatgcgaagtgatgggcttaatagatagggtgaacaatctcgaagtagaggctacgatctttggcggtgtcaaaggcttgaagatggaacagtgggaaaaaataaaagagagcgtcaaaagcatatcagaagctttgagccaagatccgatactaaaaaaagaaatggaaaatcaaatgaaaatcattgatccaccaaagggtatacgtgcaagaattgcagagaatgaaaataataaaaggaagtgatacgaatggatgaaatgacaaccgcagagcgcaaccagtatcttgagaacatcgccaagctgattgaaacgaccgcagaggacgctgcctctgccgcacagattgtgcgtgacagcatggcgtcagaggaagatactgaggaattggatgagatgacaggcaaagagattgccaggctgatggaatggctgaaagcccatgggcatacatcggacgagatcgtctcctgcgtcgagtacaccgttacttgaggtaaaggactcccgagggattaggctttcctcgggagtcctttattcgtccagagacttgacgctgtgcgcggtatgagatacactaagaacaggcgaaaatggtcgaatgagcgcccgctttttttgtcgggaaatggtgaaaaaaaattcattgataatataacgcccctaatagggggcgaggggatggtagagggtagctggatcggagtcggactaccttgaaaattcgggcaagtagcgtgcccaattttttgtcgggaaatggtgaaaaaaaattcattgataatataacgcccctaataggggggcgaggggtctggaggagaatggtatgtttgatattgtagcggcgttggagtcgcagtttgacgaggtgcattacttagatttttatcgggatatcttcccggaaggctcgttcgaggagcgcggtgtctatgaggacgggaagtacaatggtattgccgttaccatttcgaaaggtagcaagcgagcaaaacgcctgacagttaccgatgatcttgacgcgattactgatatggcagcgtccgatgatttttgtttaatgagccctataagctatgtcggaaagagtcgaaaatcctcgaatgctcggtttatgtacgcaatgaccatagatttggatgggttagagagcttgatacagtggcagcagcttatggatcagattgctcgggagcctggtgtgctggtaggaggttggggattgccacgtccgacctatctcatttcatcggggacaggacttcacctgtactatgtctttgaaaagccgatcccgatgtttaagaacattgtggaacagttagagaagttgaaaaagcgtattacttggcaggcttggacgcagggcgcgtcatcattgcatgacaaggtgcagtatgagagcctgtttcagggtttccgcgtggttggtacgattacgaaagacggtggtcgctgccgcgcgttctcagtagggaggaaggtgacggttgagtatctgaaccagtttgttccggaagagtatcgagcaacaaatttcgtttataagtcggatttgcggttatgcgcattatagaggaaatgagaaatgcaacagataaccggtatccagctttcgctgtatgggagaacgtcatgggaagtctttcttcaaatgaccggttggattttgcagccgtgcttcgcgcattcacagataccgaaattccaatgcctgatagcggtatctgggcgcacgccggaatggtgcgagggggacgggctgataccgcttggcggctcatggacgcccagtattggggagaacccgccctttcgcagcgtaggcggcgggtgttcgtcgtggcggattttgcaggagagcgtgccgcagaagtattatttaagccccgcggtgtgttcccgtatcctgcgccttgcggtgaaagcaggctgcccgccgcctgcagagatcgaatacctgctgctcaagcagggcggcaggtacccgtcgtgcgccccttccagctccggcggatgcggtcaatggcaaagcagggcgatcaaaaaggcttccgcgcgtgcttcggcaaaaacggcgaacccttcccaactctgcttgccagtgtaggacagccctttgcgttctggtatgagggcaaagagcagggcggttttatccgtgaccttacgcctttagaatgtgaacggctcatgggcctgccggagggctggacagcatacggctctaaaaatgaagccatcagcgaccatgcccgctgctttgcgctcggcaatgcgatcgccctgccctgcgcggagtatatcatggcgggtatcgcagaagtaatgacaaaataaacgataacagcagtttggaggtaaccttatgaatttactgtttgtagtcccggacaaggaaaaagaccttggcaatctggaatttggcggaccggaacaggccagccgtgaagataaaaagcgtgtcgggcggcaggaagttgttgtccagcggcggtacaagctgttttcggatgtacagcgtgcggacgatatcgaagttgtgatccctgcgcaggcgggtgaaaaacattttgcctatatggagccggtgcagcttgtcaacccgtgggtgacggcggaaggctacgcgatcaacgggaatggttatatagattttattatccacgcggatgatattatcaaggcgtaaggcagaaaggtttggtgttatactatggcaagattcggaaatggatttacagggagacatgtccctacgctgggtgagctgcgtttttcctccatgcgccgcgaggtctatgtgcagaatgaggacggtacgcggtcggatgtggtaaaagaacggacctatgatctgaaaagcaaaacgcagggccgcatgatccaggtgagtatcccggccagcgtcccagtccgggactatccgtataatgcggtggtagaccttgtgggcgcgagattcggcgctgtggcgcacgcgacgttcggcgacaatgcagatgtagactggtatatcaaggcggaggatatcgtgctggtcaagccggaaacggcatccgcgtcgaacagcgggcagcccgcccagccgcgcaaggataaccagccggataagaaagcgtaagccttatgaagcatttccggtatcgcggcaagcgtatccgcccggcggataaggatttgatgttccggtctgcctgcggtattgttctgcctgttttctctgctgtcatggttctgcttaacctgaaaaccatcctgcaaacagactggcacaggctgtccatgctgcactggaatgtgccgtatctgctgttcagcggtattgtgtcggcggtgatcgctggagtagtgctcgccttgctgtaccgtctgttcccggacactgtgcggcagctcatgcaccgtcaaaagctggcgcgtatggtactcgaaaaccagtggtacgagcaggccgaacggactaagcaggacggctttttcaaggatttacccagttcagatacaaaaacgaagatagcccgttttccacggatgtattaccgcatggaaaacgggcttttacattttcaagtggaaatcacgatgggaaaatatcaggagccgcttttgcatctggaaaccaagctggaaagcggcctgtactgcgagctggtcagccgcgagctgcgggacgggtatgtggaatataccctgctttatgatatggtggcaaaccgtatcccgattgccgaagcgaaagccgagggcgggtgcctgcggctgatgaagaacgtctggtgggaatacgatacgctcccgcacatgctgattgcaggcggcacgggaggcggcaagacgtatttcatcctgacaatcatccaggcgcttttacagaccgatgccttgctgcacatcttagacccgaaaaatgctgatctggcagacctgtcctccgtgatgccggaagtgtattaccgcaaggaggatattgccgcctgtgtcagccggttttgcgacgggatgatgcagcgcagcgaaagcatgaagtccatgcagggctataagaccggcgagaactacgcctatctcggcttggagccgcactttctgatattcgatgaatatgtcgctttcatggaaatgctgaacacgcgcgagcgtgaggacgtgttaaacaagctcaagcagatcgtcatgctgggacggcaggcggggtattttttgatactcgcctgccagcgtccggacgcaaagtatctcggtgacggcatccgtgaccaatttaacttccgcgttgcgttggggcgcatgtccgagctgggatacagtatgatgttcggtgaagtgaagaaagagtttttctttaagaacgtcaaggggcgcggctatgcggatacgggaaaaggcgtcattaccgagttttacacgcccattgtccccaagggatatgactttctgcgggagatcggctcgctggcggctgggcggcagttttcgccggttatgaaagtggatgaaagcacaatggataatgacgatacggaggacgtgtttttcgatgaaagatatgattgagcgggctttatctacgcgggataaagatgaaaatattatggggatggtgaccttcccctgcaataaggaagaagttttacagcgcttccaggtagacgatctgaaagagctgtattttgtggaccggccggacagccgtatgtcggtagcgcggtttaaccatatcatccgtgaagcggatgcgcgtgcggagaagatcaacagcatgatcggcacagcggtctgcttcctgatggataagctggatcagaacccggagtggcgcggctcgtctgaaagtgtgccgctcaattttgaggacgcgacggtctggaactggtgtatgaaagacgattaccagccggtagacgaaaagacaaaggtatggttcagccgcggcagccttaccgtgtattacggtgagcagaagaacaagcggcagtggtgaaaagatggaggacagataaatggcaatgcctgtgaaacgtctggtcacaacaaaggggcgggacgaaaacattgtggaaacggttgcgttcccttgcaatgaggatgaaatcgcaacatggtttcatgtaaacgagctggatgaattgcagttcgcaggcggttcggcgtctgatctcacagtaccggaatttaatcaggtcatgcgggaagcagacggacggatacagaagatcgaaagcaatatcgacgctgccgtgcgtttccttgaagcgaagctgcgggacaatccggagcagaaaaaagtttccgaaatggtctggctgggattcgaggatgctgcggtatgggagttctgtatgcaggacagttaccgtccggcggatgagcatatcgagctttccttttccggcatactcttgcaagtgacgtaccaggtgtaggctattctgtctgcacgccccgccctgccgcgcgcggcgtgcagcgcgaaagccgccagcgcggcaagggcggatggcgggcgcggcgaagccgcgcccgcgtgcctgaaccccctgtatctaacaggggggtacaaatcgccaatggccagccgctttacaaagtagaaaccctgatgccgtctggattttgggcttttaagggttatgtcaaaaacgggcgtcaatgtcacatgacgcagaaaggagaccatctcatggaaaacaacgaatggatttggtatttccgtgaagaacgggaacgcaacggtatttcgcgcaaggcggttgccgctgttgcaggtatttcgcgtgaatacctgtgccgtctggaaaccggaaagctgccggtgacagacaagacaaggaaaaggctcgccgcggcgctcaagaccctgtacccagacccgcttaacctgatgatcgactatgtgcgcatccgcttccctacgatggacgcaaggcatattatcgaagatgtgctgcggctcaaaatgaaatatatggcgcaggaagatcatgggctctactcctattccagtatgtatgtgctgggggatgttgttgttatgacttctccaaaggaggaaaatggtgtgctgctcgaactcaagggtaagggctgccgccagtttgaagcctatctggatgggcagcaaagaagctggtacgagtttttccggcaatgccttgatgaagatgcggtattcaagcggatagaccttgcggtcaatgacagggcggggattttggatattccctatctgtgtgataagtgcgaccgcggggaatgtatctcggtattccgcagtttcaaggcataccggacaggcgggcttgcacatctgcgggaggaaaacaaagagagcatgggcgcgacgttgtatatcggctcaatgcaatccgatttgtatttctgcatttacgaaaaggcctatgaacagcttgtgaaaaaaggcatcccagtcgaagatgcggaagtcaagaaccggtttgagatacggctgaaaaatgaccgtgcttattttgcggtttatgatctggtgtctaatgaaagccccgaagatactgcgttcggcattattaaccggtatgtccggttcgtggacagggatagccgaaaatcacccgaagattggccgctgaaccatatgtggtcggtgtttattggggaacatcgtgaccggctcaaactgacgactgaccctgagccgtacagccttgaaaaaacgctgaactggctgtcccatcaggtcgcgccgtcgtggaagatgctgctggagttagaccgcaaatgcgggacaaatatcatggaagaaatgcttgcggcaaccgagctggcagataagcaccgcaagatcattgaacagcagcttcaggaaatcggggatgttgtaattacagaataaaatgcaagcaaaagtttaattacaagcggaatggaggaatattagcctatgaatttcggcgtcaacctttacaactggtttcttacgaacgcccagtctcttgtgcttatggcgatcgtggtgattggtatttatctcggctttaagcgcgagttttccaagctcattggttttctggtcgtgtcgctgatcgcggtcggccttgtattcaatgcggcaggcgtgaaagacgttctgctcacgctgttcaatcagatcatcggcgcataaggaatggggtgtggatgtgcgctatcgtcaaaaccgtatcaagatgctgcgcagggcgcgtggtatcacagtaaaacgacttgcggtactggtaggcgtatcacagagtatgcttacaaactatgaaaatggaagcagtataccgagagatcaggaagtatgggacaggctcgcagtgtatttcggtgtgtctgtcccttatctcatgggcttttgagtttgatgtaacggctggtttcaatgtgagaccggccgtttttatgcctgcatggtggaggtgagaatggattatggaagaaatgcgggtatatgtagcgaacctcggcaaatacaacgagggcgagcttgtcggcgactggtttgaaccgcccatagactatgacgaaatggcggagcgcatcggcccgaacgaattttacgaggaatacgccatccacgactacgagctgccctttgagatagacgagtacacgcctattgaggaagtcaaccgcctgtgtgaaatggtggaggatttgccggagtatatccaggataatttacgtgaactgcaaggctatttcagcagtattgaggatttgtgcgaccatcaggacgacattatctattaccccggctgcgaagatatggcggatgtagcgcgtcaaatggtggaggaaggttatatctccgtaccagaccacctgatatactactttgactatgaagcgtatgggcgcgacttatctatggagggtacgtttgttgaaacgcggaatggtgtgtttgagatcgcagtttaaccgttttctctttcgcccgccgctgtgagaatggtgtgggggtgtgtccggctgtgggtaactgcatggcagttatccataaccgggcgcagggggcgaggaaagacgcaggcggcgtgggcctcgttcctcgccccccctacccatatatttttggaaaacaggagttagaacaaatgaatcataccaaagatgcccgccgtatcggccttgtcgatgtgaacgggcataacggtttcccgaaccttgcgctgatgcggatttcggcatggcacaaggcacggggtgatacggtcgagtggtgggacgggatgctgtcttatgaccgtatctatatgagcaaggtgttcaccttttcaccggataacgatacggttatgcaggcggacgagatcatcaaaggcggtaccgggtacagggattacggcagcctgccggaggaaatagaagccatgccgccggactactcgatttacccgcgttacccgtatgctgtcggtttccttacgcgcggctgtatccgttcctgcccgtggtgtatcgtcccgcgcaaagagggcggcatccgccctgccgcgacatggcaggagatcaagcgtccggacagccggacgatcatttttttggacaataatgtgctggcgcacgagcacggtttgcaacagatagaggaaatgggccatgcggatgtgaaagtggatttcaaccaagggttagacacccggcttattacaccggagatcgccgcaatgctcgctaagctgcattgggtgaagtatgtgcggctgtcctgtgatacgtctgatatgctgcctgtgatcgcgcaggccgtcgcctatctgcgggaagccggtatcggtacacaccgcctgtggtcgtatatgctggtgcaggatgtagaggaagcgtatcaccgcgcgcttgtcttgaaagcattaggcatccagccattcgcacagccgtaccgggactatgacggcgggtgtgagccgacagcagaacaaaagcggtttgcccgctgggtaaaccgcaaagaaatattctatacctgcggctggcatgagtaccgcagacggaaatagaaagaggtgcaatgatgtgaagaaaatacgaagttacagcagtatctggtctgttgagaaagtcatatacgcgatcaatgatatgcgcctgccgttccccatcaccttttcgcaaatggcttggtttgtcgcctgcgagtttgcggtgctggcgctgggggaactgccgccgctctccatgatagacggcgcgctgctcaagtatttcggcatccctgccggtatcacatggtttatgagccaaaagacatgggacggcaagaagccgttcagctttgtaaaatcctacacggcctatctgctgcgccctaaacagacctttgcaggcaaggcagtaaaattccgcaaggagaaaacaggacagcccattacggcggtgaggagcgtgatagtagatgcagtatccgattaaatatatcgaaaacaaccttgtctggaaccatgacggggagtgcttcgcgtactatgagcttatcccatacaactactcatttttaagtgtggaacagaaagaagctgtgcacgatgcgttccggcagcttatcgcccagaacagggacggcaagatacacgccctgcagatcagcacggaatccagcatccgtgcggcgcaggagcgttccaaggcgtatgcttccggcaacctgcgggaagctgcgctgcgccgcatagacggacagacggaagcccttgtctccatgatcggggaaaatcaggtggactaccggttctatatcggcttcaagctgctgctgaacgagcaggacagcgggaatatcggccgtcaggcggcaaatatcttttccggtttcctgcgggatgtgaaccataccctgatgggtgatttcgcatccatgccgaatgatgaaatactgcgctatcagaagatggaaaagctgctggaaagcaagatttcgcgccggtttaaggtgcggcggttggataaggatgatttcggctatctgctggaacacctgtacgggaaaagcggcaccgcgtatgaggactatgaatttcatttgcccaaaaagaaattaaagggtgaaacgcttgtcaagcggtacgacctgatcaagcccacgcgctgcctgatggaagaatacgggcggtacctgcgcatatcgcatgatgactgtgaggcgtatactgcttatttcacgatctcggatgtggtcggggagctggatttcccgtcgtccgagattttctattatcagcagcagcaattcacgttccccgtcgataccagcatgaatgttgagatcatcaccaacaagaaagccctgtccactgtccgcaataagaaaaaggaattaaaggatttggacaaccatgcgtgggaaagcggggacgagaccagcacatcaattgcggaagcactggacagtgtgaatgagctggaaaccgaactggggcaaagcaaggaagccatgtacaagctgtcctatgtggtgcgcgtcaccgcgccggacgaggaagaactcaagcggcggtgcaatgcgatacgggatttctacgacgatatgaacgtcaagctggtgcgcccggtgggtgatatgatcggcctgcaccatgagtttatcccggcaagtaagcggtatatgaacgactatatccagtatgttatgagtgatttccttgcgggtctcggtttcggcgcggcgcagatgctcggggaaaaggacggtatctatcttgcctatggcgtggacaccggccggaatgtgtatttgcagcccgcgttggccagccagggcgtgaaaggctcggtcacaaacgcgctgtctgcggcgttcctcggctcgctcggcggcggcaagagctttgccaataacctgctggtgtattacgcggtgctgtacggcgcgcgggcgctgatcgtagacccgaaagcggagcgcgggaactggaagcgtgatttccctgagatcgcggacgagatcaatattgtcaacctgacctcggacgagcgcaaccgtgggatgctggacccctatgtcatcatgcgccgccccaaggacgcggaaagtcttgcgatagatattctcacgtttttaaccggcatttcctcgcgggatggcaaccacttccccatcctgcggcgggcggtgcgcacggtcacgaacagcaaacggcgcggcctgttctgtgtcattgaggaattacgcaaagagggttcaccgcttgcggtgggtatcgcagaccacattgagagcttcacggattacgactttgcgcacctgctgttttcggatgggaacatcaaaaagtccatcagccttgaaaagcagctcaatatcatacaggtagccgatctggtgctgccggacaagggtacttcgtttgaggaatttacgacgatggagcttctgtctgtcgccatgctcattgttatcagcacctttgcgctcgacttcatccatacggaccggagtattttcaagatcgtggatttggatgaagcatggtcgtttctgaacgtcgcgcaaggcaagacgctggcaaacaagctggtgcgggcaggccgcgccatgaatgcggcggtgtatttcgtcacgcagaatgcggcagaccttgcggatgaaagcctgaaaaacaacatcggcctgaaattcgcgttccgcagtacggacattgtggagatcaaaaagacgctggagtttttcggccttgaccctgaggacgaaaacaaccagaagcggctgcggaacctcgaaaacggccagtgcctgatgcaggacttatacgggcatgtgggcatcgtgcagtttcatccggtctttgccgacctgctgcatggttttgataccagaccgccgctgaaagccgaggtggtagcatgacgcacaaaaaagtgaatacagctttgttcaaaaagacggcagtcacaggcacttgtatccttgtgattgccgtttttctgtttctggtgttctgcccgtctgcgggcgcggttgggctcgtggatgatacggtggatgcggcgcacgagtacagccgctacccgctggaaaattatcagcttgacttctacgttgacaacaggtgggattggctgccgtggaactggatagacggcatcggcaagcaggtcatgtacggcctgtactgcatcacgaattttatctggacaatcaatttatatctttccaatgcgtccggctatctggtacaggaagcatacgggctggactttatttcggatgcagcggacgagattggacggaacattcagtctatcgcgggcatctcccccagcgggctttctgcggatgggttttatgcgggcttcctcctgcttatcatcctgattgttggtacgtatgtggcatatacggggcttatcaagcgcgagacgacaaaagcggtgcgtgcggtgatgaacatggtgctgatcttcgtgctgtccggtgcgctgatcgcctatgcgccggactgcgtgaagcgcctgaacgagttttccgaggacgtcagcacagcgagtttgtccgtggggacaaagatcgtcctgccggatgtggagagcagcggtgcggacagcgtggatttgatacgggacagcctgttttccattcaggtcaagcagccgtggctgctcctgcaattcggggatacggacacggacgcgatcggtgcagaccgtgttgaaagcctgctttcggccagccccggcgggaacaacggcgaagatcgggaaaatgccgtcaaggccgagatcgaggacaacgggaacaccaacctcacggtcacgaaaacagtgaaccggctcggcacggtgttttttctgttcctgttcaatctcggcatctcggttttcgtgtttctgcttaccggcatgatgatcttctcacaggtgcttttcatcatctatgccatgttcctgcctgtgtcgtttgtgctcagcatggtgccgacatttgagggcagcagcaggcgcgcggtgatcaagctgttcaatacgatcttggcgcgggcgggtattacgcttgttatcacggtggctttcagcatttctaccatgctgtaccgtatttccagcggctatccgttctttatcattgcgtttttgcaggtggtcgtgttcgcggggatttacttcaagctgggcgacctgctcagcatgttttccctccatgacgacggtgcgcgcggcatgggacggtatatcctgcatcgcccgcggatgttcctgcatcatcagctccacaggctcaaccggacgatgcgcgcggcgacggccagcagaccgaatgacggcggcagtacgcagaacagccgttccagcagtacggcaggcacagcggacagcggataccggtatcgcagcaaccggccggacggtgggagcagcggggcatcacaggcgggtgcggtacacggcttgccggaagtgcctgtaaggggcttacccagcggcggttcgggaagcggcaccggcgcaccgccacaagggggtaacccgccgtcccatgatggcatgtatgatgctccggcggctgtacttcccgcccagtcggacaagcctactgcggggactgccaagagcagcagcacggcgcgcagccgtccggcaacggcatctgcacaggaggaaacaaaacgtccggtaacggcagcggaacaggtggaaacaaaatattctgcaatccagcaggcacatgaaaggccggtcattgcggccggtgcaccaaaggcggagaaagcgcaggacgttaagcccaagcaacagcttgtctcaggcagacagggaaggcctgcggcggtggatgctgttggtatggcacaggtttccggcggcacagcacgcaaaccggcagcccagccgcatgaacgtccggcggtcgctcagacggatgcaggcgaacgtatgaagcaaccggacaggcagaatgtcgcatcggcaaaacagtccgtccacgcggaaagccgcaggccggatgcggtagaccgtccggcagcagtacaggcgaaaaatgctgcgcaagcacagggcaaacaggatacggtgcgccctgtcgtgacagccgcgcccaaggtgccggaaatgaaaaatcaggttcccaaacctgccgataaacgtgcggtgcagcacaaacagccggtgacgatgcggaacaagcccgatggcatggggcatactggcaacgtgggcggcaagcagaatgggggcaacagtaaatgaagctgaaatatcttgcgctgccccttgcagggctgtttgccgtcttcttctgcctgctcctgctggttgccctcctgtttgcatcagacgaggacggcggcaggggcggcatttactatggcggtgcaaatctgtctgcggcggtgctggcgcaccggccgatggtggagcggtacgcggcgcagtacggcatttccgagtacgtcaacgtcctgcttgcgatcatacaggtggaatccggcggcacgctggaggacgtgatgcaatcctcggaatctatgggcctgccgccgaactcgctcggcacggagcaatccattgcacagggctgcaagtatttctcggaactgatcgacaaggcggaccggctcggctgcgatctggacagcgtgatacaggcgtacaactatggcggcgggtttctggattatgtcgcgtcgcacggcggcaagtacagcttcgagctggcgcaggcgtttgcagaggaaaagtccggcggtgtgcgtgtgacctataaaaacgagatttcagtcgcggaaaacggaggctggcggtacgactatggaaatatgttctatgtccggctggtatcggagtatttgtatgccgcacagtttgatagcgagactgtaagtgcgatcatgaatgaagcactgaaataccagggctgggaatatgtctacggcggcgcgtccccgacaacatcctttgactgctccggcctgacgcaatggtgctacggcgtggcgggtatcaccttgccgcgcaccgcacagacgcagtacgacgcgacccggcatatcccgttcgaggacgcccagcccggcgatctggtgttctttcaggggacgtataactgcggcgattatatcacgcacgttgggatttatgtgggcgataaccggatgtaccacgcaggaaacccgatcgggtttgcagatttgaccagcgcctattggcaggcgcatctggtctgtgccggacgggtaggacagtgaagtacagaaaggcagggaaacgatatgttccagaatagaaacaaaaatcagggaaaacagaaaaagccgcgtgtcctcagcattgggacgcggcggccggttgtgatcgcgctgtgggcgctgctcatctgcgcgtttgctttcgcggtgtataaggattttacagcggtggatacgcacaccgttcatgaaacgacagtggtgcaggaggaagttacggacacgaatgcgatagagagctttgtgacgaatttcgccaaggtgtattactcgtgggaacagtctgcggattcgatcgagcggcggacagaaaacctgaaatattatctcacggacgagctgcaagccttgaccgcggacacggtgcgcagtgatgtgccgacggcgtccactgtacaggacgtacagatttggtctgtggaagaaattggggataaagtgtataaaattgtctattccgtgtcgcaaaatgtcataaacggggaggagagcagcgttatcacgtctgtttatgaggtttccatgtatgtggatgatacgggcgatatggtcattatccaaagcccgacaatcacgggaaagccccaaaagtccggctacgttcccaaagccgccgagccgaatggtacagtatccgcgcaggagagcacagagatcacagagtttttgaccacgtttttcacgttgtacccagcggcaaccgaacaggagctttcgtactatgtcagcgacggtgtgctgccggtgattgggaatgaaagttatgtgtttgcagggttgatgaatcccgtcttttccaagagcggcgataccgtgacggcggatgtggcggtgcagtatcttgaccagcggacgggtatgacgcaggtgtcgcagtttacgttgcatctgcggcaggttgaggggaattggaaaatcagttgttaatattagaaaaaccatccgtccaatgggcggatggtttcctttttatcagtcatagctgattttaccgttcttatcacaggttatagacatagtgagttttttcccgcctgcataattgaaagtgcagtagccggatactttgttccccgaccgcgacgaatcgccggaataaccatacgaggaggaagcggaccagctatcggccgttgccttagaagttacagtatcatactgaaatgttccattcaaatagaacgtgccgatataggtgtttccatgataagcatcagctttagatgttgcggttttctgataaatggctctggttgctgcttcgggaacatactcagttagcgttactttcaggtaatagccgtctccacaatcaataattgtggtgttggaaacatcagcagcaaaggctggaattgtaaaacatacaagcataagaactgctaaaactatggaacaaatacgctttttcaaaatgaagcctcctaattttctaacatttcatcagaaataagttgcccgtcgctttctgtgttagaacgagtaaaatagaaatctccgcgtataacttgctgtgcatgtatgtaatatgcagccagcaatagtaacaatacgattaaaatgcctattacgagagtaatgacaaatcgatgcttgcgcttgctaacagcaatttcagtctcgtcaacgctttccagcagttgttctgcaatctgctcaggattaccaacttttgcacatagttcgttgtatgacaattccgaataagccgataattcctgtttcaatccgttcaataacttggagcgtgttgctttagaacagattagtttgcgggaaactgcacgtacatattgacgcacaatcttatcctccatcatgcgttgccacctccggtgttttgatgaatttgctgtatcgctttagacatttcagcataaacggcctctatctgtcgcaaatacgatatcccatcggaagtgatttcgtaatactggcggacacggttatcgtctgaaatcgctttttggccttcgcacacatacccttgagataacaggcgttggattacaggatagagcagagaaatagtatatctgccatcactgcgtttagatatctctcgcatcatctcatagacatacattggttgctcagatagcaacaaaagcacgagcaagggattcaatgcgcgtttgaagtaatctgcaaaggagtggccagtatccttggtagatttgctttcctttttcatggcgccaccaaacatgtttgttgaaattatactatcacatcatttcagtttcgtcaatatttagtattgcttaataatttgcatttatatataattggattatcaaattacatcatataaaacagttttttacaaaggggtgatagaagaatatactttaggaagatttactatctaatcgagaaagaagggtgaagtatgtatagtaaatgtaaaagaatggttggtttattactgatctgtgtccttgcattgggagtttcagccgctgcgtttgaaacgcagatagagcctcgtgataattggcatgattataccggtgagcttccggcggatactggtgatgtggaagtttcaacagttaaaaaggcatatacaaacaactattttgctgtgtcttgcaaatcatcgcgatccggattaggttctgtaaatgtttggactgaaaccggttggggggtaaatgcttcatctcccaatcaccccattaccgcaaatggaataattaataatgtgaattatactaacaaaccgtctattcaaactgaagtcacactgaatattgataataatagcgttacctctaccacttatccaattgagggtaggtggtctccatactaagcgtattgctattatgaatttaagttaaacgtattgtataacatattatatgaagataccttggggagtgcttatatggcgacttcccaaggttatttatgaggttaatatgagttgcttaagaatagatatcaaaaggttatataattcaattactgtaaggatagttttgggtgtgctgttttttttagcaattgtagatcccttatattctcgttttttaacgcttgattctatgtttgcttcatactatggaatcaacgcttaccagtattggcttttcaactttcccggtggcattggatttaaagtttatcatgcactgtttttacttcttcctgtattatcgactggttttattctattttatgatcagaaaacctctttcaaaatatataacattgttaaacaaggtagagcaatatatttgacttccaaggttatatctgtgtttcttgttacaatggtaaactcaattgtctctttttctataaatattttaataacattttccatatttccacaaaattcgatcatgacagatgtctatcggatgtttattcctattgaacattctgcagcaaattttttttacgaaatttcacctgttttatcagcagtttttttcgcatttttaaattccctggcactgtctgtattggcggctttaactgttattatacatatgatatttagatttccaaacatatatgtggcttttttcgttccctctattttatgcctattaataacttatggaagtgactttttactacctaaacgttttgtcttacgaaattttttgcagccgttgaattcatgttacgaaggagctgcgcagcttaaggacatactattggttttaagtggatattttattctcgaaatattattatttacgattgcttatagaagaaatagggatataatatgattctatttagtcacaaaagtaaatattttatttgggtgggattcctttactttatattcccgttattatgtatttctttttttgctgatacgcaagatttgtggttcaaaaacattttctcagacaaaacatttgttatgcttattatgcctgcatttgtgcttggtgctgtcataatagattcttctatcagtccagttattatggtacgtacaaaaaataagttacattcatttactttgttgcgtgatcagcagtattggtttgcaataatttataccattatttggatgctttctatcattttcattactcagattattttcggaaaaatttatgcaatatccttttgggggttaattagagaatttgcaagatgtatttgtggatttattatatttataaatatatctttaattataaaagtaaaatgcaagaaaaaatatatggcagcatcatatattgtagtctatattttttttactgcagaaattttttcgattgttccactattaaataagtttttcccaattaatatatatttgatttttagctggctatttagagatactataataagttatttagttatcgccggctggataagtgttacatattatcttggaagaaaatcgtccaaaaatatggatgtcctttaaatgataatagtgttggaaagaggatattatgcttattaaattacaagatgctacaaaaatacttgatcacagatttgtaattaataatataaattttgagtttaaaagtggaaatatttatgggattgttggacaaaatggtagtggaaagacaatgcttctacgagctatagcagggctaatctgtttaaatcgtggtactattactgtagatggcaaagttttgaataaagatatatctttcccgcctgatataggaatcattattgaaaagcctgaactattaccatatcttagcgggttagagaatttaaaattacttgcagagataagaaacaaaatatcttatgatgatattaagcattatatggataaattcggattaaatttcaactccaagcagattgtaaaaaaatattctttgggaatgaaacaaaaattaggaattattcaagcaattatggaggatccttccttacttcttcttgacgaaccattcaatgcgcttgatgcagagtcggtagatattttgcgaagtatattacttcaatacaaagaacagggaaaattaatcattttaacttcccatcatcaagaagatataatgtcagtctgtaatcaagttatccatttacaggatggatgcatattaaactgatagcaaaaatatcataaagataatgccgcttcaagatgaggcggcatcatttctgttataagtggttataatgtattctactaattccggcgttagtccgcatatatcggctatttgataaagagtatagccgcattgagcatagtcctgaatctcagttgctggatgcaacagcagcgccataaaacggttcgcttctgtttccagcttgtttacagaatagagcgtgtttgctctcagaaatggtgtattgcttttcgggtgtaagattgcatgtcctaattcgtgcgcgcatacttgccgctgtcgctcttttgaaaggtcttgattgatatgtatgaacttgattctgtgtgtgcggctgtaatatcctctgatacttccaaggggttcgtggagaactcgaataccgagttttgcagcgattgtgaacgggtctctggtatcacattttcggcataacatatcgaccttatgctttattgacaatatgcagcacctctatttcatttccggtacttttttggagtaaacttttgcttggcaatccgtttggaaatttcaagctggttttgcaggctaatgcgcaggagttcccgcgtttcatcgtcgattggctcaccatcaaacatcaggcttgcttcggcgtcgccaagatcacctaaaatcatatccagtctttttgctatgtcacgctcgtcccgccttgtcaggacgggcgtttctttttgctccatgttaagtaaaaattcaatcggcacatttaggtaatcggcaatttttgaaaggtttttagtagaaaggtttttctttcgtcccactttgagatcggacagcgatgcacggcttatttcacattgcctgcatagctctgtaactgtaattcctttttccgcgcacaatgcagctattttgttgtacaactctgacataaaatcacccgtccatttgtagtatatgccaaaattacgcaattacgaatttttacacgttgacacttacgcgatagaataatataattcactcatagatttcgcaaaaacgtaatttatagaatacatatataatattacacttttatgtaaatgtcaatagaaaggaagtagttgaccatgaaaaaaagggaactttgctcgtttggtaaaaaaattaaccatcggcttattgctcttgaccaaagcaaagggtggctgatcgaagaagtaaagcggcacacagggttgtactttgaccgctcctatcttcgcaaaatcgaaaccggccagcttgcgacgccgaagatcgtggatgcaatatgtgaaatacttggcatctctgttcaggatgattgtaccaaaagaaaagaccgataaaatgtactttttgaaaaagaaaagcggattacatatgcaccttgaaaattgaagatacaggcagcagatacaaaactgtttgcgccgagctgcgatacccatgcgcggggacaccggacaggtccggacgagcgggaaaacatgacggtacgaaatgcgggtggctcccgcaaagcgacgacacgcagacagataatgagacttccgtccagccacagacacaagcaatgggggcggctgatgtgagaaccacgcagaggtaaaacggcctatggtatcgttcgccagcgatcatctgtctgcttccccacaagtcgggacgttgagaacaaataggcttggcagcaggaaaggatgtgtctaaagtgttttaaggttttgcggcagacgggagattactgtctgccgcgcgtacatcacataagcagacaggatgtgaatgaaatgccagattgggaaatccagccgaagaaacataaatacgaagttggcgaacgtgtattagtgcgacctgcaattatagatggtatctgggcaaaagccagttgccgtaagaccgtgcctgccacggttgtttttgtccatccagacgaccgcttcattgtagcagaatatcaggtgtgcgcttcgttctttggcgggacggtatctgcgatacgcgaaagtttttcaattcaaaaagttcagagtttggcgtgggagtgaagtgaatgtataagcgtggggatgtgttctgggctgatctcagtccggtcattggttcagaacaggacggagtacgtccggttgtaattttgcagaatgatattggaaacagatattcgcctacggtgattgtagcgccgctgacaagcaatttgcatcgggacaagcatcttgttactcatgtgcatgttcaaatgcagggcttgccgcaatattcggttgtgttgttggaacagataaggacaatagacaaagcacgactggggaattttgttggtgcaatggataaagcgacattgaaaaagattgatgaaagcgcgctgcgcagtctggggctggcggatggatttagagcatagagcgatcgagcggctgcggctggcggcggaaatgagcgaaacctattacggccagcctttggtgattacaacgagcggcggtaaggacagcgacgtatgcctgtaccttgccgccgcttccggtatccgttacgaggtcatgcacaaccataccagcgtggacgcacctgagaccatataccacgtgcgtgagcaattccggcgtttggaacaggatggtgtgaagtgcaccatcaatttcccgcagtataagcagcggccggttaccatgtggacgctcataccgcaaaagctgatgccgcccacaaggacggtaaggtactgctgttcgattttgaaagagaccggcggcatgggccgcatgattacgactggtgtccgctgggcggaaagcgccagccgccgtaacaagcgcggcattttcgaaagcatgccgcacgatctcagcaaaaaggttatcatcaacaacgataacacagatacccgccttttgttcgagagctgcaaattgcaggcgaaacgtatctgcaatcccattgtggattggtcggactatgatgtgtggtcgtatattcatgctgagagaataacggtcaatccgctgtattcgtgcggcttccatagggtcggttgtgtgggctgcccgatggcaggacgtcgaatgcgtttggttgagttcggccgctaccccacctatcaacgcgcgtacatccgtgcttttgagcggatgctcgaagaacgtaccgcgcgcggcaagctcgatggttcatggcgggctgggatgactggtgaagaagtgtttcgctggtggatgcaggaccggaatattgacgggcaaatgaagattgagggctttgacggataaagcccagatatgtaccgtgcgggttcccgcgcggtttttcatatatacacgaaatttattatgttaggggatggtacctatgtgcagttcagcgcatggggtatccatgcaatgttggtttgaaacaagttttgaacagaatggagtgaaaagatgggattcctgaaaaaacggttcaagcgggttacgtcgatgggacttgctttgctcctgtctgcgtcggcgcttccgtccacggcctttgcctcgtcggacagtacccttgccgaagtaacggcaaagtatatcgacgcagagaacggcaaagagatcgtcgagccagagacatacagtgtgacacacgaggaaaagtcaccgcaggagatcgagaactacacctatgtcgattacgcggagagtgtggagtatatctactcccataaagacctgacgtatatcatcggctatccggatgaaagtgtgcgaccggatgcgtccatgacccgcgccgaagcggctaccgtattctaccgtctctatgacggcgagtatccagaattcgagcgccgtatgtcaaacggcacgtttgaggacgtcaagacggattgctggttctacaaggaagtcgagacgctgtataacatcggtattgtagacggcacggatgaacacaaattctcaccggacgcgccggtcacccgtgcggagtttgcagtcatggcggcgcggttcgcaaatttggactacgagggcggcaacatctttgaggatgttcctgctggacactgggcgtatagctatattaacgcggcggccaatgcaggatgggtagaaggctacccggacggcagtttccggccggatgagccgatcagccgtgccgaggtcgtgcggctggtaaacggtatgattaaccgtaacgtcacgctggacaagctgaaagagctggtcatcgaatgtccgtacaatgatctggttgagaatcactggggttactgcgatctgatagaagccagcattccgcacagcgcggaagaatggcacggcctcagctacaatgacggtatttacaacatcatcgttgaaaaattcatagaccagaacggcaaggaacttgctgaaactgtcaccacagcgggcaaggaagaaagttcacccaaggtcatcccggcatacgagtaccgcggctatatccgcacgatcgtttatcagtacacgaacggtgatgcgatcccgtccattgaaaagacggcgaacgccaaaaccgccaatgtaggcgataccctgacctatacggtgaagctgacgaatgatgaagcagcttcttccgcgtggaaagaagtcgtcctcaccgacgaaattccggacggcttgactttcgcggatggcagcgtgtacgtagaaagcaaggcggcaaagcactcgtttgaaaacggattgctttctgtccctctgggcgacattgccgcaggtcagacggtttcagtcactttcaaagcaaccgtgaacagcgatatgtacaaccagacgatctacaacaccgcagtcgccgagggcgcaaacggtatcgttaaggatgaaagcggtagcgaaaccggcaagtatgaggacacagacgacggtgtttatatcaacaagggcgacaccgcgccctatgtggaaaaacgtgcggacaagccttccgccgaggtcggcgataagatcacctataccgtcacgctcggcaacgcagagggtgccgtttatgaaatcgaaaacgcttccatgaccgacattatcccggcggaactggattttgtggacggcagcgtgcaggtagacggtgtaagtacaggttattcattcgataacgagacccgtaccctgaccgtgccgctggacagaattgcaccgaatacaaaaacgacggttacttttgcagcgaccgtcaatgaatcggcctacggcaaaacagtttacaacactgcggtcatgtccggtgacaatatttcggacaccgagggcacagacgacggtgttgccatcggtgacggtaaagcccgccccagcattgagaagtcggcggacaagtcctctgccaaggtcggcgacaagatcacctatattctgacgctctctaacagcgagaccgcgactgtacccgtagaaaatgcggccgttactgatgttatccctgctggcctgacgttcgagtacggctcggtcatgctggacggcagcggcacgagtgatttcacctatgatgaaaatacccgcctgctgacggtaaacgtcggcagcattgagccggataccagccgcacggtttcctttgtggcgaccgtcaacgaagatgcctacaatacgacgattcagaaccttgccaccctgacttcggacaacaccgagccggtacaggacaaggacgacggcgttgtcgttgcagacggtatgaccgacctgtccatcaacaagagtgttgataaatcttctgctcgtgtcggtgatactctgacctacacggtacaagtctccaatggtgcgggtgcagaggtaaatatccgcgacacggtgatgcgggatgctatcccggatggcctgaccttccgcggcaacgtcacagtggacggctactcaacggtatatcagtatgacaatgaaaaccgaaccctttctgttccgctggatgcgatcgcccccggccagacgaaaactatttcgtttgatgtgctggtgaacagtgatgcctacggcatgatgattgagaacacggcggtcgcttccggcagcaatgcgccggatacggaggacacggatgacggcgtcaccatcgagaacggcacgccggacggccgtgcgggtgcaaagtcagccaataaaatgaccgcgcgcgtgggtgatacaatcacctacacgatcacgctggaaaatagcgcaatggcaacggcggactggaccggcgttaccgtgaccgatgctctgccggatggtgtgactttcacaggcaacgtccagaaagacggtcaggcaacgacggaatattcctacgattcatcttcacgcacgctgacgctcacgccttacgcaatcgcaccggatacgcaggtggtgtacacctttgatgtgacggtagacgagggtatgcagggcgaatttatcgtcaatacggctattctgacggatggcaacgagcaaacgccgcttccggatgcaggcgtgcagatcaacaagggcgaagccgacccgattgtaactaagtccgcgagcgtgaccaaagctgatattggcgatatgttcacctatgagatcacggtcaaaaatggcgataaggctactgcgccgtggaaaaacgtcgtggcatacgacacgcttccggctggcgtgaagttgatcggcaacgtgtatctggatggtaaggtggcgctgcataagctgaacggtaacgcgctgtccgtgctggtgggtgatttggctgcaggcgaaagcgtagtaatctcctttgatgtgcaggtacttgacacagcggccggtacgacccttcaaaacagcgtggatgtgaccggcgataacggcatcggcacggcaacagatgacggcgtaaccgtaccggaggttgagccgcaaaaccctaatgatgccaccggcttctatgtcacaaaagatgtggataagacggtggttgatgtaagtaaggatgccgacgaagtatccagaacggcaacatttacggttattgttggaaatcacagtgatataatgtgggaaaacgtcgtgctgaaagatacgctggatacctctgtggtaacgcctgttttgcaaaacaatgtttatgtgaacggagtcctaagtaataaatggagtttttcaggcaaggcattcactctggaattgggtgacattgcacccggccaatcgcataaaattttgcttaccgtccgctttaagaacgatgcaggcggcaagacctacgtcaactatgcgaccggagagggcgataacggcaatgctatcggaaagtcgccggaagttgaaattatcagctcagttgctgatttgataactgatattcattatcagctttataatggttatgacgaaaatatgtggcgacccgcagaccgtatttcactgcaagaagcgtgcatcgtagcatatcgtctgatttccaacggcgggaacacgtggctggaccgtggcacggtgacggtgccggactacgagttcagcatccccgaagaagcaaaatattttgtctctatcggtgtgctgcccgcaagcgtattcgacacaacgaaaatgaccgaagatgttgattacgaaatcaattatgaggtttcggaaaaaggctatctgcgaatctgggctacctcggaacagcttaatacgcttgtgaagtatatcactggcacgaatgcagggctcagcggtgatgtgtcccgcctgaattttgccaagctgatttgccagcttaccggacgggataccgacccggatacctcggcttacagcggccatatccaatatttcacggatagtggttcttctgaggacctgattactgaagtctcgcacgaacacgattatgtgcttgacacagacgggaatgagtattggatttaacaattttataggaaaaggcaatccctcgtttcgttgtgaaacgagggatttgcttaccgattatttaattctgttattgttagtttatcaaaaagctgcaaagcgtacactttctcaccttggacataggcagagacagcagtagtttttgaacgggtgttgagcatattttctcgatgaccttgtgagccataccatttgtttaagttttcctgcgcattggttgtaattaaacctatgagtgcattttcagcattgcatccataaccaacagatgcgaacaccgagccatccggtcttgtatgagaaatatccccgtctcgttcgtcaacaatccagatttcgcgggaacgaatgtccgcccattcctgtactttcaacgagtaagtcagacgtggcaaaccgttttcttcgcgcaggtcgttgatggcgtcaaaggtggcattggacaggtcataatcccaatagccgccgtactcgtctaccgcagatttgccgatagggcgtagactgatttcatctgttacggtctggttatcgtctgcggtttcgttgtcggtatcatccggcacaggctgtccgtctggtgaaaccggtgtttccggctccgtcggttcatttgcgtccaagatgttttccgcgttcatcagcattgttgcgacttcggcacgagtagctgtcccgtgcggatttaactttccgtccgagccgctgacaatgcccttgttgacgcaccagctcatggcgtttgttgcgtaacgggaaactgattgatagtccgagaaatcatagtatttatctggtataaagccggtatctgtatcaaggccaaggtggtccgcgtagcggtacaggatggccgtaagctgctcgcgggtgatcgcatcattcgggccgaactgcgtatcgctgtacccggtaacgaggtcattcatgcgcgcccagtagacaggcgcgctgtaataggcgtttgtatctacgtctgcataggggtatccccagttgctttcgggcatatcaggtgaacctgccagtcggtacaggatggtcacgatcatgccgcggctggtagttgcgttcgggctgaacgccgtatccgatgtaccattcatcagcccgttttcgcaaacatagttgaccgcatcgtgataccagtccgacggacggacgtctgaaaagtccggtatacttgccgcgcctgccgaacaggttaaagcggtagcacacaagatagaagcgatttcttttttcataaagtcataccccacaataaagaacagaaaagattatcatggtttcattatatcatgttgctgtccgttccggtagcgggcatggcgcacaaaaaccatgtggggattttgaattgcaaacgagatgcagtaaattgttgctgcatagatgataaccaatacgcaggagggctgtggtttatggattataaaattttgacgcaggacgatttgcttgagttgttcccttttggcaaaaccaagctaaaatgcctgctggaagcaggcgtattgcctgtggtgaaagtgggacgggattatttgacgaatgaacgtgaacttgaccggtggtttgaagcaaataaagggaaagagatattttactgattgaattgcctttacagagggacggcgttataatatatgcgttagctgtttatgctgccgcccctgtttatttgataggagcgatacgcatgaatacagtagaaaatatcaataaagttaagagaatccgcggatatggggagggtagtgtatatcagcggaaagatggccgctgggtcggcaaatataaggacgaaaagatgttgaaaccgcgttatgtctatggtaagacagaagcggaagcaagacggaaattgcgtgaatttaagaaaacaatagtgcatggcattacggattgtagaaaagtattgcttagcacttatattgagcgatggttatatactttcaaggccgcagccgtggagaataccagctttgatcggttggagtctgtctattacacgcatatcaagccgacgcttggcggcttccaacttgggaatatcaaagcggttgatattcaaacactgttaaaccagaaaagcactgaatattcttatactatcgtcaagatgatccggcagatactttctgaggttttccaacatgcctatactgagggtgacattcttaaaaacccaatggcaaatgttatcatggcaaaacggagcaagtttaagccggagcggaaaatgctgatattagaggatgcagaggttaaacggttggaggaagcagccagagagaagtatggtacaggccgtccgctttttgttcacggaaacctgatcgtatttatgctgcataccggcctgcggtgtggtgaactgcttgcgctggaatggtctgatattgactttgaaagcaagacggtatccataaataaaaatctggcaaaggtcaagaacagggataccggaaaagatacgtccaaaagcaccttacaggtaaaaggcactaagacatccagcagcaaccggattatcccactaaatagtaaagcaatcaacgcacttagggaattgcagatgatttacaggcaatgcggcatcaaaagcaaatatgttgcctgttcgcaaaaaggcggcttcctcactaataaccgtatgcacaatttacttgagcgtatgttgaagcacacggggatagacaagccgctcacgatccatcagctacgtcacacttttgcaagccgtgcgttaaatgctggcgtaagcatcagcgtagtaagcaaatggatggggcatgccagtatttccaccacatataatatctacattcacgctatggaacaggaacggctgacagcgttagacgttcttgaagctatgtagcgaaaaggtgtaacattggtgtacgcctctcgaaaaaacgacttaaagcccagtaatataggcgtttaagggtgcaagagggggaaaaccgcaggtgtctaccctcttgtgcgcccgcgcggcgtcagcgcactcccccgccgcggggcgcggcgaatcccctcgctgaggttcagcgaaaaactctccgcccgttagggacgaacacgcttacgcagttcgcgcaccccgctcagccggtgcagagaaaaaggctgccgcccgtcaggggcgaacatgcctgcggcagtttgtgtcccccgctcagccggtgcagagaaaaaggctgccgcccggacagggcgaccccgctcacgcagtttgtggcccccgcctaattactgccagaaaacgcaaaaacctccgtacgaaccatacggaggttttttctatgtcttatctcgtctgctgggtgataataaacaccggaatgtaccaaataagctgatacagcaggatattcatcaccggaagcgcgtctgcggcgttctggtacagcaggtagaacacgatcagcataccgagcaggccggcgaacgtgccgagcgtcagcgccgagcgaacggcgcctgccagcttatccgcgccgcggagcacctgcatgaacggaccggcaccctcgcgggtgaggatcgctgccggtgcatcgcccttggcgtaattcggattcagcagacgatccacgcctgccgggtccggctggtcggcaaaaccgcgtcggaggtcaaactcctcctcgaccatcgccggggagatattgaaatcgcgaacggcgaggaccgcattcatgtgcatgcggcgcatgaggcgcatcgccttataggtattcttggtggtctggtagcgcatggtcagcacgcctgcaagcgcgttatccacaaccagatacatgttgatctgacccttatgaccggattcgatcggaatgcccatcttaaccatgagcgccgccgtgccgagcacgatacggctggtgccgacagcgccggttacaccgccctcgaccagacgcacgtcacgcgcggtgaaggtgatgccgaagcgctccttcgtggtatcggtcagcactcggcccagttccagaccggcggattctgtcagcgcggctgcacagccgagaatctgctcgtccgtgatgcggcccagattgtcgatagcctcaagctcgatcgagccggtcgggaacagatcgttctcgagcagcatgaccttctccgtgccgcgcagcaggttggcctgacgcgcacccgcaatggctgcacccgagcgcagcaggcggcttgcggtgttcttgtagcttgcgccgaacgcgcacagcagaccgaccggcgcggacaccgacaggattgccgagaacgcccagaagaagcgcaccggctcgccgcagttgaacgaagcgaccagcgacaggacgattgcgagcgccagtgcaatcggcgtatagatgagcgagaagcggtcaaccgtgtccgggcgctcgatctcggtcaggaacgagcttgcgtcgtacagcgggcacttgacggcgttgcacgcgtcaatctcgctgtcgtagtggctgtaaaccgccagcggctgctctgcctcgcagacggcacgataggaacgcgcctgcgccagactgcggccgcgtgcctcacgcatttcggcgtaaagcagaaggatggaaaccgccgtgtacggtacggcgacgccgccctgatccggaaataccagcagagaggcacagtgcagcagcgatgccagcgccgcgaacgacacgagcgtgccgcgtgccggacggccatgcagcagcgaggaaaagccgttgccgaacacgtcaataccgatcagcagcgccaggatctgcagggcagccagtgcgccgatgccgatggtcgggttctgcagaatatcgagcacgaccggaagcggcagtgcctcaaagctcggtgcaaagctgagatacgcggcagctgcggcaaggatcagcaccagcagcgaccggaacgacagaatgcccgaacggcggcgtgccgcgtgcatagccacctcgggatcgaccagcttgatatcttcttcttcctcggcctgatcggcggcaatacgtgccgctcttgcctgcttgcgcgagatgcttgccttgcggcttgcttcctcggcagcggcttcttccacgatctcctgctgctcggcggccttctcggcagcttccttttctgccagcttggcctcgcggcgtgcctgccgctcggcgatcttctgcgcggtcctgcgctcacgctcttccattttctgctcgcgcgccgcgatgcgcgcttcgcgcgcttcttcaacagactcgtgttcggcggcggcgatctctgcggccttctttgccgttttatccttcttatttctgggagccgtcttcggctcctctgccttggtctctgccgccggtgcgggctgcggctcgaccggcttttccggctctgccgataccttaggcattggctctgccgcctttgcggacgcctgaccggacacctcggcgatgatggaatccagatcaaattcatcggtatccggtacgtcgctgagcatatttttcagcgattccagatccatatcgtcttttctatccatgttcacttcccccttaattgccctgtgtgcgtcggcgaagcgcctcaaacagcagcacagccgccgcgttggatgcgttcagcgagttgacacggcctctcatcgggatgctgacgatgtagtcgcacttgtcgcgggtcaggcggctgagcccctgtccttccgagccgatgatgatggcggtcgggcggtcaaacggtgcgtcatacaggccgaccgtaccgtcagcctccgcgccgaacagccatacaccgcgttccttgagttcatcgagcgtggacgcaaggttgtttgccttgtgtacgccgacataggcgagtgcgcccgccgccgaacgagcgacagccgcggtcagaccgacagctctgcgcttcgggatgataacgccgtgtgcgcctgcggtctctgccgaacggatgatggcacccagattatgcgggtcctcgatgccgtcgcagacaacgatgagcggcacttcactgcgctcctcggcgacgcggaaaatatcgtcgagcgagacgtactcctgtgccgccgcctgtgcgataacgccctgatggttgccggtcgggctcatgccgtccagcttgcgccggtcgcaggtgacgaccggaacgcgatgcctgcgcgcttctgccgccacatcaccgatgtgtgcgccttcggccacaaacaccttatccactgcacggcctgcgcgcagcgtttcgaggacggcgttgcgtccctcgatcagcgtgccgtcatcctcaaccggaggacggcgtctgtttttttcatatgccataaatttttacgctccaaaatgagaaataactttgcatatcctcagatactttcagttagtttcattatacacacttcccgactgtttttcaatgttagacacgaaaattatacaaacatcgccgcaaaagtgctgccataagttcgacagatatcgacaattcgctctgccgcatttacacagccagattttaggcgatacaatgaaaccgaactgaaaggagcgaggacatccatggatggcagaaaatttgacaaaaacacactgaaaacgcttgtaatcgcggcttctctgctgctgaactgtgttttaggcggtgcatcgtacacctattatcatcatctggcggagcagatgaacgagaccgcttccctgcagtcgcaggtaagccatctggaaggctcggtctccgacctgcaggcgcaggcggacgaatcccagccgaccattgacggtttgaaagcgcaggtgtcttcactcaccgaggagaagaacggcctgcagacgcaggtggacacgctcacgagccagaaggcggatttacagaaacaggtggatacgctcaaagcaggtgcatcgagcggttcgtcctccggcggttcctcgagtgacagttcgtccgtcccggcagcttacagcagctcggacgaccagagcgaaaccgtctacgtcacgaacaccggctccaaatatcacagcgccggctgccgttatttgaagaaaagccagattccaatgtcgctttccgaagccaagcggcagggttacaccgcctgctcggtctgcggcggataacatgaaaaagaagctgagattttgtctcagcttcttttatttgcctgttattgtttgcctgttagaataatctgtccatattctgccgcagcatgcgaaccatacgttcgcagtcgagcatggtatcatccgcgccgaacatgacagcggtctgatcgactacgctcgtatccggattgctgctgccgaccacgacccgaccgttcttcacgcggtccatcacggtatccgcgttattgatgaggaaatccagttcgttcatcaggctgctgttgtagtagcagatcgggttggcctgctcggtcatgccgctgcggatggtctgcgccttgcgcttgatggaatccagcgccgccatagcagccgccttatcggtaattacatagtcggtataactgccgtttttcaccgcagattcgcaattctcgaacttttgcgtatccgttcgcatatcgagcagctgcttcatgaggttcgtcgcgtaggcttccatttcggcgcgcttgctgtccgaaagcggcatgcgcaggaagatggcgttcacgtcattctctgccttggcgctgtaccacgttacatccatgccggtcagctcaccgatgttgcgcagcggcagatagatggagtttcggtaaaacatcgggtaaatggtctcgcccttctggtttttgaaggtctgctgtttgccgtccacgagcaccttcacgcccttatcgagcgtagccgtgccggtcgcaccgacatattttacgccttccttgtggtacgcatcgtcatccgcacacggataggacttttccgtagtaccggacaggaacaccgtgcgcgatgcactgtcccacgagatatttttgcccatccagcggccaaccgtgcgcagcggcatgtaggtcgaaccgttgtagctcagcgccgtgtaaaccgtcttgccgtcctcgctcgggaaggtggccggaatgccctctgcatagatgtccgcgctctgcggattgatttttacggcggtgcgggtctgcgccgtattctgcgctgcagcctgcacccccgctttggaaatcacggtggtctgcacatttgctgcgcctgcgctcatcatcagtgcggacgccatcaggcagcccgcgagtgtgccgcttacgattttcttgaacttagtcataattgcccctccacataatacagttttttctatccatacctatggtatacaacaaaaatcatattctgtcaatctattttcctgatactattataacgaccgggagcgccgttttgtgacaacaaaccgctaaggatttttttcaaaaaatttgccacagaaaatcctgctcaggcgttgtataattgaatggtatcatttccaacccaagggggaaccaaattgacacaggagcaaatcctcttttttgaggaatcatatacaaagtattacaggatgatggtgcagaccgttctgcccattgtcggcagccgcgatattgccgaggacattgtggccgacacctttctcatcctgctggcaaagataaacagcgtgatggagcacgagcagccggtcaagtggctgttccgtgtgctgaaaaacaacgccatcagcgaataccgcgcgcagtgcagacacgcggccgcgccgcttgaggaaagcattctgcgtgcagccgaacccgagctgataccgttttccggtatgctgccaaagggcttatccgcgtccgaacagcgcattctgaccctgcggctcgctgaggacatggactattccaccatttcggaaaaactcggcatttccgagaccgcctgccgcagccagtacagccgcgcacggcggcactgcgccgaacttatggaaaggagtgacgacaatgcaggattctaagcagattgacgagctgttccggctgatggacgacgtttgcgaaaacggtgatgcggctctgcctgcgctcgaacagtatttgcagacgcagacggacgcgccggaaatcgacacagaagcgtcgctcaaaaagttcaaggccgaccataaggaatttttcgtcaagccgcaccgcggacggcggctgtgctaccgcgtttttgttgtcgcggcggctgttttcgccgcaggaaccgtgtttgcgctggctaccggacacaatccgttcgactatgcggcgatgtgggattccgagacgttcggcattttccagagcggacatgacgattttgagaccaccgaggatgggtatacgcattttccggatggtacatcggtgaattacgagcatgcgaccgacacggtggaatacgacccgaatgcaccgctcggctcagaggcgaatcctatatatgaacctgtgcagccagacccggactacgttaatttaccggatacagatttgtccgatattggtttggagaaaaccgaatcaaattgggctcctggacatacaacggagtatttcgatattaccaatgcagatttgaaaaccacgttagaaaaatacggcataaaacagaagatggcacctacaaaaatcccgccagagttttctgcagctcaaattcaaatcatgcacgagtatgtttttgatcagacttcctattgtggtttttacaggaaacccaacgaccctgacagttctgatattctggtaatcattgatatcccactaaccggcagtataaacggcattgaaaaggatagccgtccggttatcgaatataaaaaaccaaatgccacatggtacatcatgcacaatctggagcaaatcaacgcggttgccatgattgaccaatatgaagtgctgatttctgcaccgctttcggtagatgaggtaaaggaaatcatcgactccatctacgaataacaaaaacccgatctccaacagacacaatggagatcgggtgctttttatgcgaaaattttatggtacgcgtgcgagacgtaaccgccgacagcggcggtcatttccttggacgccacggctttatccgccacggtgacgatccacgcgattcgcgtgcgcggcatggccgccagcggaaacatatgccgtgcaatggcttcgcactcccgctcggacagaccgaaggtatgcttggcgcggtcggctgcgatgtggccgtgaatgaacccgtgcatgtgggcaatgcggtgcacgccggaaaaatggctcagataacggcgaaagcgctcgccgtgccagtcatagccgaaaaagtcatgcagcagcgcggcacggacaaccgaggtcgtttcgctctccgacagacgcatcaggcgggcgatctgacaggctgcttccgctaccgcaacggaatggtcatacacagagttgtccagtccgtggtgacagaacgtgcgaagctgctgaaaacgcggatgtgcaaggatatctcccgcgtactgctgaatttcactgtccatcggacccaccttccttccttttgatgtctttattatagtgcgcttagtgcacaaaatcaagaggtaatttgtaacaagtttgtgacaaaaaataccaacaatctgcttagccgagcggcggcgtgtccagtatcatctgcctgtactccaaatcctcaaagccgagcatgtgatagagggcacttgcccgcacgttgctttccgttacctccagacgataccgcgcggctgtgttgtacttttcgtgcaccgcggcgatgagcctgctgccgatgcccttgccgcgccgctcgtcatccaccatgatttcctccagccagacgcacagaccgcccgcctcattcgaccaggtgagcgctagcaggcagtacgcgcacggctgtccgttctcgtcctcggcaatcaggcagtccgcatacggcgtgccgtgcaggagcagctcaaacgtgcgttcggcgttctgctgcgggatttcatggtcgcaggcaggcgttttgtagaacgcatggcagcggtcgataaaaaattcgcggtcagcggcttcaatagagcgaatacgcatagtttcctcctaaaagaacagggcatgcccgttgacacaccctgttttgctgtaaaatgattaaatctggttaagagcctgttccaaatcagcgataatgtcctcaacattctccagaccgaccgaaatacgcaccatgcccggctcaatgcctgcggcaaccagctgctcatcggtcagctgacggtgggtttcggacgccggatgcagcacgcaggtgcggatgtcggcaacatgaacctcattgcacgccagcttgaggctgtccatgaacttcatcgccggagcgcggccgcccttgatgtcgatggacataacgcccgaagtgcccatcggcaggtacttctgcgcacgctcgtagtgctcgttgcccggcagtgcgggatagcgaacggatgcgatcttgtcgctcgactcgaggaacttggcaacggccagcgcgttctcgcagtactggcgcatacgcaccggaagggtctccagaccgaggttgagcaggaacgccgagtgcgccgccggatagcagccgaagtcgcgcatcagctgcatacgcgccttaatgatgtatgccatcgcgccgaactcgcgggtgtagaccacgccgtggtagctttcgtccggctcggtgaaatccgggaacttgcccgatgccgcccagtcaaacttgccgccgtccacgatcacgccgccgccctgtacggcatggccgtccatgtacttggtggtcgagtggatgacaatatccgcaccccattcgatcggtcggcacagcaccggcgttgcgaacgtgttgtccacgatgagcggcacgttgttcttgtgcgcgatgttcgcccacttttcaatgtcgaacacggtcagagcaggattggcgagcgtctcaccgaacacagccttggtgttgggcttgaacagcttctgcacttcctcctcgcttgcctctgcgtccgcccagatgcactcgatgcccagctttttgagcgttacgccgaacaggttgatcgtgccgccgtagatggtggaggctgcgatgaagctgtcgcctgccgagcacaggttgaggatggacagcagggatgccgcctgacccgaggaagtcagcatcgcgccgacgccgccctcgagggacgcgatcttcttctctaccgcatcgcaggtcgggttggcaaagcgcgagtagatgcactctgtcggcatatcgaacagggacgcgatctttgcggtcgagtcaaagcggtaagtggtggactgcacgatcggcatgacgcccggaccgccgttttccggcttgtagccttcatgcaggcattttgtttcgattttcatataaactacctctttactatgatttaacacagaagaatcttcacctattgtagcatgcagaagcctgtcggtcaaggcagttcggttgaacaaacggcaatatcatggtatgatagaggcagtacaaagggaggcaaaccgcatgaaggatctgctcattaccctgctgaatacagcgttctggttcggactgcatttcggtacggctggcgcggtatgcgctctgccgaaggacgtgcagacgcgatggttcgacccaaaccggcgttttttcacggtttccgactgggaaatgcggattttccgcaagatcggtctgccgaaatggaaggaccggctgccgcagttcaatcccgaatttgacaagcggcacctcaaatccgggcgggatacggcatacctcgaccgttttctgttcatcacctgccgtgcggaggtaattcattatgtgatcggcgtgctcggctgggtatcgctcgttttttgtctgctgagcgccgaccggacggcgtggctcatccggtatgcggtcattgcgcttgcgattcagctggcgaacctgccgttcgcgtggattcagcggtataaccggaaacggctgctcagcgtccgcaaaaggctttcattgcggatagaaatttgatataatataaagatagcataaggataatcaaggagattttgcaatatgacagacgaaaaaattgcacgcatcaacgcgcttgccaaaaaggctaagaccgaaggactgaccgacgcggagaagaaggagcagcaggagctccgcgcagagtacgttgccgatttccgcaagagcctgaaggcacagctggacaacacggtggttatcaatccggacggcagctcgtacaagctgaagcaggacaaaaagtgatgcggctgcccgaacacgcggcacacgccatccggcgattagagcgtgccggatttgaggcgtgggcggtcggcggctgcgtgcgcgacagtctgcgcggagtcgaatcgcacgactgggacttgtgtacgtccgcgtctccggctcagatgcaggccgtgttcgcggacgcgcgtgtgctcacgaccggactcaggcacggcacgctgaccgtactcacggacggcggcccgctcgagattaccacctaccgcacggagggcggctactcggacggacggcatccggacggcgtgcgctttgtcaccgacattcgtgaggatctggcccgccgggatttcacggtcggtgcgatggcgtggcacccggaacgcggtctgtgcgatccgtttggtgggcaaaccgacctcaaaaacggcgttctgcgcgcggtcggtgatgcagacacccgatttcaggaggatgcgctgcgcatcctgcgtggactgcggttcgcctccaagctgggattcgccatcgagccggaaaccgccgctgccatgcggcggcaggtgcatcgcctggactgcattgccgccgagcgcatccgtgaggagctgaccggtctgctgtgcggccgctatgtgcagcgcacactgatggcttatgccgaccttatcacctctgccctgcccgagctcgcgcccatgcagggctgtcagcagcagaatccgcaccacctgtacgatgtgtgggagcacaccgtgcgcgcggtcggtcaggtgccggccgagccggtgctccggtgggcgatgctgctgcacgacagcggcaagcccgcctgcaagaccgtggacgagcaaggcatcgggcatttccggggacatcccagggcgagccttgcgctgtcgcgcgagctcctgccgcggctgcggttctcgagcgcggacaccgaacgcatcctcctgctggtcgagcggcacgacacaccactcggtgacaacgaaaagctggtgcggcgcagcctgtcgcgcatcggagaggcgcggttccgcgacctgctggcgatcaaaaaaggcgatgcggtcggtcagggcaccagccgcgactatgtggcgcagctgtttgagaccgaagcgctgctgaaccacgtgctcgcgcaggagcaatgcttctcgctgcggcagcttgccgtaaacggagccgatttacaggcgctcggtctgcgcggcagaccggtcggtgaaatgctgcacgccctgctggatgccgtgatagacggccagaccgacaatcggcgggatacgcttctgcggcttgcccgcacccgaatggaggaacaacatgacaaataaagagattttcatcgaaacctacaacaaaaacatccatcgtccgggcgcagaaaagctgcttgcatggctcgagggcacggatttcttcacggctcccgcgtccacgcggttccacgctgcgtatgagggcggtctgctcgaccactcgctcaacgtgtacaacgtactgatctccaagcatttcaatcccgaaaccgacgatctggaaagctacaccatcgtttcgctcctgcacgatctgtgcaaggccggtttctacaagaccgagctccgcaaccgcaaaaacgaccgcggcgagtgggaaaaggtgccggtttacgcagtagacgaccagtttccgtacggtcacggcgaaaaatccgtgttcctgatcgagcggttcatgcggctgcgcaccgaggaagcgatcgccgtgcgctggcacatgggcggctttgacgagtcggtcaagggcggcagcttcgcactcgcgcacgccttcgagaaatatccgctggcggtcaagctgcacctttccgatctggaggccacctatctgcacgagaacaggagcgaatgagcatgaagaccaaggaattttccatctcgaccgaccatgagggaatgtacaatatcacctcgaagctgcgcgaggtcatccgcgagagcggtgtgcagagcggtcttgctgtggtgtactgtccgcacacgaccgccggtatcaccatcaacgaaaacgccgacccggatgtgcagcacgacctgctgctcggtctgcgcgaggcgtttcccgaccggcgcgagttccggcatgccgagggcaattcgaccgcgcacctcaagtgcagctatgtcggcccgagccagaccgtgctcatcgaggacggcaagcccctcctcggcatctggcagggcgtgtacttctgcgagttcgacggtccgcgccatcgccgctactatattaaggtaatggcggataattaacttgcacttgcttttccgctctgctataataaagtcaaacatactctaaaaaggaagatattctcatggaagcactggaatgtatcaaaacccgccgaagcatccgcaagttcaccgagcagcctgtgaccgaggacgaggttcgtcaggtcgttgaagctgccgcctttgcgccgagctggaagaatacgcagatcgcgcgctacatcgttgtgaccgacaaggaaaagaaggacaagctggccgacaactgcatgctcggttttgcctacaaccagaagaccacccacggcgcaccggcgctggtcgtgctgaccatgatcaaggagcgctccggctacgagcgcgacggctcgttcagtaccccgcttgccactcactggcagtcctttgatgcgggcatcgccgcacagaccttctgcctgtccgcgcatgcgctcggtctcggcacggttattatgggtatttacgatcccgccgaggttgccaaggtcgtggaaatccccgagggtcaggaagtggccgcgctcatcgcgctcggtcatccggcacaggacccgcaggcgccggcgcgtaaggatgtcgatacgctgctgcgatttgagtaaaagtgcatactttgagcaccgtggaagcaattctgcggtgcttttcttttctctgcacaaggtgaccagggcacacgaactgccgcaggcgggttcgcccctgacgggcggttccttttgctgcaccggaaagccggggtgcgcgaactgccgcaggcgggttcgcccctaacgggcggagagtttttcgctgaacctcagcggggagctgcgctctgcggagcgcggggattcgccgcgcccgcggcggggacggcgccgtacccacggcggagggcaaaaaggaaggacaacctgcggttttccttcctctttgaactcctacctttcccttgtttgttagcccggcgcagattaccgacatgtgaccgctccgaaattgggtacggcagaggattttttcttccgtgtttttcgtaacctgttcgcagtaccagatacattactgccacacagaccggaaagtctacgcaggcgcgacatgcccgtgtcgcgcaactcgttagtctggagattacagacagcacctacgaagataaattgtgccaaacatctaaatccgcaggtgccgggcggtataacgcgcaaaaaaaattgggcggcactgtcatgccgccctctgcgtggagctaatcttatgtgtagcagaatggtatctgacactgcgaataggtaaagaaatgggaacacactgtgctcccctacggtagaaaaaatcctctgccgttcccctatttcgcagcggtcacatgtcggcaatctgcgccagactctccaagggaaaggggtgattcacaagagggtggaaaccgcaggtgtctaccctcttgtgccccggccgggcaggccatgtcccgctgaatttcagcgaaaaactcacaaatcctgaatattcatcttctcgatctgctttttgcggttcatccctctgcggcagagaaaatataccgccatcagcacgatagtcggcagcagcgtgagaaacacgcgcaggatgacgttcacacagcccgccgcaagcgtttctgcgccgaaaaacgcgactgctgccacgttcggcaggacgaacagctcgcccagaaacaggatgcccggcagaacgagtcccggcactttgctctctcgtctggaaagatatacctcgagtgcgatggcacccacgctcacgagcagcaagatcacgcacgcgataatgatggttttggttgcaatcagcatgatttattcccctctctcagctttttgtactcgttgatgagcagcttcgccgtgtcaaaatccagcttgtccttgaccgcaagacgcttgatgagcgcgatatacggctcctcgtccgcctgctcgccaagcctgatcttctgtatcagacggtccagacgcagtctcacggtcggataggtcacgccgtaaatgcccgcgacctccttgagcgaacctgacgccagcacgaattttttgataaacgacacgtcctcctcgtccagcgatgcaagccactccggaattacctcgattgccacggctatcacttcctttcattgtaacttcattataatattaaattatattaaagtcaatctttaattttatcaaagtccggaaataaaaaacggcacaccgggagattctctccggtatgccgtttgctgtttcttacttacttttctactcgtttctggaacgccagacgttctccgcgcccattttccagctcaatgacaccgcaataggtatagccgagcttgttcagcagaccctgcatgggcttgttgttcgcgtgcgtgtcgatgcggatgttgccgcactgctccatgcaccagttcatgcagaacgaagccgcgccgtgcgtgccctttgccgccgcgatacggtggacaacgccgtacggcgcatcgtccagccaggcgccgccgcgaatgacgtgataggtcggctcgccgtcggtcgtaaacgcaaaggtcgctgcgattttgccattgtcctcgcagacgtagctgcggtgcagcgcaagatccttgtccagcatttcccgcgtcgggaatctgtctccccactgatcgggattgccgttttcgcgcataaatgcccgcgcgtccgcaaaaatttcctgcatcgccggaagatcctccggccgggcgtgtcgaatctgcattgttattcctccttcagccattccgcgcagagcgcctgccagcggtttatatgccggtcgggcacgcgccctttcatcgggtcggctgtctccaaatccgcgagcgcgagtccgtgcacgccgtgcgggaacaggtgcagctcgtggctgatgttttctcggcgcaaagccgcctcgagcagcagcgtgttctcgaccggaacggtcgcgtctgtcagggtgtgccacaaaaatgtgcgcggcatgcgcgcggaaaccagcgtttccagcgaaaatctccgctgttccgcagcattttcacctgccagacacacaaagctgccgcggtgtgcatacgctcccgccgagaccaccggatagcacaacaccgccgcattcggtcggtgcgcctgcagatccgtgcccgcaggaaaccagtctgcgtcgtgccacgtcgccgccagcagtcccgccagatgggcgcccgccgaaaatccgccgaccgcaatgcggtctgccgcgatgccgagctgtgccgcatgttctctcacccaggcgacagacgcggacagcgtgtgcagcggctttacgccaagcggcaactccgtgcagtcgtactcgagcacgaacgcttccacaccgtcccgcgcaaacgcacgcgcgaccggtgcgccctcccggatggagcagtattcgtagccgccgcccgggcacaggatgagcgcaggcttattccgtccggctgatgccggaaaatgtgtcaaaacgccgtgatcgagccgcaaaacctctttcatcgcgcacctcacacgttgtagcggttgcggatatcaatgcacgcaagaatgcggtcggtctccggcttttcgcctgccagcaggtagtccatgagcagctcgatcggacgggcgccctgcagggcggcatcctgatcgatcaggaagtcgatgagtccgcggcgaacattctccgcatttgccggaatcaaatcgtggcagatcaggtgcaccttgccctgtaaacccagctcacgcagcgcgtcgcacgcaccgagctgaccgtttaccgaaacgtacacaccgcgcagcgacggatgctcctgcacggcgcggcacacaatatcatgcgccagctgctgatcgtccccgcaggtctgcggcggcagcaggctcaaaccgggaaaatttgcggcagcctcggcctgaaagccgtccacacgctgctgatgcgaccagttgttttcctgaccggcaaccagcaggacttccccgtgaccggcgagcagcaggtccatcagaccggcgctcatgcgtccgcacgcgaaattgtccacgccgacgtagcacaggcggcccgagtccggcagatccgagttgaaggtaacgaccggcatgcgctcggacagctcctgaatacgggcgcgcacccgctcgtcctccgccggagaaagcgcgatgccctgcacgcccgcctcgagcagttcgtcgatcacgtccagctgctgctgtgcatcgacgccctccagcggccgcacgagcacctctgcgccggtggtggtaaagtgcgccgatgcgcgttcgatctcctcaaataccgtgtgcatgaacatggtctcgaccgactggacgattacgccgatcctgatcgggtttttcgcgcgtgccagcatgcgtcccgcacggttcgggcggtagcctcgctctgccgcaatgcggcgcacgcgtgccgcaaccttgggatcgacgcgtcctctgtcgttaagtgcccgatccaccgtgccgcgtgaaacgcccgccagcgcagcgatctctgccaaagtgactgccatgaattttcgctcctacataccgcgttgcgcggtgtcattccaaaggcaccaccacacaatttgactgcggtgttacctttttattttacacgtttcgaacgaaaattgcaaatgcaaatcagtgaaatcgacaggaatcggtcaatcgtccagcagttcgcccttgatggaaatggtcttcacctgccacggcagcagcttgccgcagttctgcagcgcggtgcggacggcgtattccagtccgccgcagcacggcacctccatgcggacaacggttacgcttttgatgttgttctgacggaggatttcggtcagcttctcgctgtaatccacatcatccagcttgggacagccgacgagcgttaccttcccccggataaaatcctgatggaagtttgcgtacgcgtaagcggtgcagtctgccgcgatgagcaggcttgcgccgtcaaaataaggcgcattcaccggcacgagcttgatctgcaccggccactggcgcagctggctcggcatcggaatgaacgaggccggctgattgaccggggcgcgttccatactccgtgccatgctgcccgggcatccggtgtgcggctgagattttgcctgcatattggcctgcacagcggcttcgtcgtaagcggcggcttcgcgctcgacgaacgagatggcgccggtcgggcagaccggcaggcagttgccgaggccgtcgcagtagtcgtcgcggagcagagtggctttgccgtccaccatgccgatagcgccctcgtggcaggcgtgggcgcacaggccgcagccgttgcatttttctttgtcgatttcgataattttgcgaatcatagtgttttctccttatatatcctgtttcttgtcttgagatggttccgctggggccgcctacccggcgggggcacaagagggtagacaccaaggtttccaccctcttgtgaatctcccctttcctatgagggcacggcgaaatttgcagagctgagactcgccaaggaacgagcgtactgctcatcttccataggggcgcacagtgtgcgcccatttctcgacctcagccgctcaagctgttttcgtactgccacacagaccggatactctccgcagagcgcggcatgaccgtgccgcgcaactctttaacgcgttataccgcatggcacctacgaatttaggcatttggtacaatttatcttcgcaggtgctgtctatcataacgcgcttacgacttgcgcgacactgttatgtcgcgcctgcgtagagtaaaccacatgtgtagcagaacggtatctaaccctgcgaatgggttgctcaagaggacggactccgaaggtagttcgtccgtagcagagaaaaaatcctctgccgttcccctatttcgcagcggtcacatgtaggcaatctgcgccagactatccaagggaaaggggtgattcacaagagggtggaaaccgcaggtgtctaccctcttgtgcgcccgcgcggcgtcagcgcactccccgctgaggttcagcgaaaaactccccgcccgtcagggacgaacacgctgacgcagttcgtatgccccggtcagccggtgctgaaaaagagtgccgcccggacagggcgaacacgctgacgcagttcgcgcaccccggtcagccggtgctgaaaaagctgccgccccgttcgggcgaaccgcctgcgcggttcgtgtgtcccgcttgactttacgctcatatcttactatactgagaaggcaaagtatgttgtcccaacaacaaaacaggaggaaatatgaacctgtccatccttgcacgctgcggtctgttccgcggcattgaaaccgcagaattatccccgcttttacgccgtctgcacgcctgcacgcgtgaatttgacaaatttcagccgatttaccgtgtcggcgataccgcgcatgcgctgtgcattctgctctcgggcggcgtgaatatcgagcgctgcgacgcatggggccacaagacgctgctcgaccacattacgcccggttcggtattcgctgaaacgtacgcctgcgtccccggcacgcccatgatggtctccgcggtagcggacgagccgtccgaggtgctgttcctgccgagcgaaatgctgctctcctctgccgcgcaagacagcgcgcacagtgtgcttttacgcaaccttctggacgtcaccgcgcagaaaaacctgcttttgacgcgaaaaatcttccacacaagcccgaaatccatgcgcggcaagctgctgtcgtacctgtccgcgcaggcggtgcagcacggctcggacacgttcgacattccgttcgaccgtcagcagctggccgactacctcggcgtggaccgcagtgcgctgtccgccgaactgagccgcatgcagcgcgacggacttatcgcatacaaaaagagccattttgtgctcaaccattcccaatccgatgaataatccaccctgttaaggaggtttttgttatgaactgcaaaccctacatccgcgcgcacgcggacgaactgctggaaagtcttgccgcgctcgtgcgcataccgagcatagaaggcgtgccggaagagcatgcgccgttcggccgtgagcctgcccatgcgctgcacgaaacgcttgcgctctgcgaaaagctgggcttccggaccggcaatatggacgaccgcgtcggctggtgcgagtacggcgagggcgaggaaatggtggctgtactcggtcatctggacgttgtgcccgccggcgacggctggaccgagaccgagccgttttccggcgaaatcaaaaacggccgtatttacggacgcggcacgatggacgacaagggcccgatggtggcggccatctacgcgctggcggcgctcaaggatgccggatttgccccctccaagcgcatccggctgctgttcggcaccaacgaggagaccggctgcggcgatatgtcgtggtacgtttcgcatggcggcgagctgccggtgtacggcttcacgccggacggcgaatacccgatcatcaacggcgaaaagggcattctcaacggcacttatagccgaaagctgcaccagaccggtgattaccgcctgacaaagttcgagggcggtgccgcctccaacatctctccggcgtatgcggcggcagagctgcagtgtccggcggatgcagcttccaaaatctcggcggacaaggtaaccgtcacgccgatcgagggcggcatccgcgtggaagccgagggcattgccgttcacggctcgaccccggagcagggcgaaaatgccatcggacggctggcgcaggcactcaatcagctgccgctgaccggcgagcttggcgactgcatggcatttgtggcagagcgcatcggcatggaggtacacggtgagtccctcggtctcgccatgcgcgatgagctgtccggcccgctgacgctcaacctcggcgtggcaaaatttgagcaggaaacgctgtcgctcgttttctcggtgcgctacccggtcaccctgaaatacgatctcgtatacccgcgtctgtcgcgcggcttcacgctcggcggctttaccgaaaccgaaatgacgcacgcggcggccatttacatgccgcccgaaagcgaactcatccgcagactgtccaaggtatatgaggagcagaccggcgagaaggccgagctcaagagcatcggcggtggcacctacgccaagtccatgccgaaccttgtcgcattcggcccgatcttccccggcgatgaggtgcgcgagcacaagccggacgagtacatggagatcgagcgcgtgctgcagaacgcggaaatcatcgcggcggcaatgtacgaactggcaaagtaaggagactgtatgagcagagagacaaatatgacggtcggccgcccgacaaaactcattctcggactggccgtaccgctgattttgacaaatgtcggtcagcagctgtacacggtcgcagacgcatccatcgtcggacgcggtgtcggtgtggaggcgctggccgcactcggcgcgaccgactggctgtactggctggtgctatggaccgtgcaggccatgacgcagggcttttccgtgctcgtgtcgcagaccttcggctcaaacgataagaagggactgcgcaaggccatcaccatgtccgtgctgctgtgcgcggcagtcggcatcctgctgaccgtggtgtttgtgtcctcggcaggctggctgctgcacctgctggacacgcccgagaacatctatgacggcgcgcacatttatttgaccatgatgtatgcgggcacgctcatcacgatggcgtacaacatggcagcggcaatcctccgcgcactcggagacggcaaaagtccgcttattgccatgtttactgccggatgtctgaacatcgtgctcgatctgctgttcgttatccgcttcggctggggcattccgggcgctgccgccgcgacactgctcgcgcagctgtttgccttcgcgtactgcgtcattacgctgcggaaaatcccggctgcgtccgtcgaaaagccggactggcagccggacagcagtgtgatccggcgactgtgccaccttggtctgccgcttgcgctgcagcattttgtcatcgtcatcagcggcatcatcatgcaggcggttatcaacacctgcggctttgtgttcctcgcgggttttaccgcgaccaacaagctgcacggtctgatggactgctccgcgtccgcgttcggctacgccgcctcgacctacaccggtcagaactggggcgcaaaccggcttgaccgcgtgcgaatgggtgtccgctcgacgcttgtgctggcgctcagcttttccgcgctgctggcggcgggcatgatcctgttcggccgtcacgttgtcgcgctgttcatctccgcagatgctgccaacgccgccgaggcgctgtcggtcgcgtacgattatctggttgtcatgagcacgtttttgctgtccgcctatgtgctgcacacataccgctcggccctgcagggcatgggctttacgaccgcgcccatgctctccggtctgaccgagttcgcaggccgtgtgggtgcatcgctgctgctgaccaaggccatcggtgagcgcggtctgttctacacggacgcggccgcgtggacattcgcagcggtattccttgcggcatcgtactatatccagctgcttattataaggaaaaagggtctgacctatcaaaatacaaagtaacaaaaagaggctgtaaagttaatttacagcctcttttgcgcttattcgccgtagattccggcgcggtcgttgataaccagcgtgcggagcagctcttcggtcaggtcgagctttccgtgctcatcgccaagcagccagcccttgcgcgtcagcttctcgacagtcggcttcgcccacgcgggaacggcggaaacgctgttgtacgtcctgcgggtgctctcgatgatcttctttacctcggcttcggtcatgtcaggttcctcctttttctgtaacccctgcttgaatgctgtccacgcggatacgctctcgacgaacggcgcaggacagtttttgtgcgtaacatcgtagtggcgcacaacattttcgagcggaataccgtatttcgccatcagttcgcgcgtcagcgcctgcgcccggcgcacggtctcgggcataaagtagaatttctcgccgtttttgcggctgcacagctcaatgccgatgctgttcgcgttgcggcagtacgggtggaaatagacgccgcgcgtgccgcagtgccatgcgatatccgcgtcgcggaccgactgccagacctcgttttcgtccacaaaatagtgcgctgaggtcgaaatctccgcccgagcgaagtaatccgcgttatttttcgcggtatcgccgtcgtttgcggtgaaatggatcaccagatagcggatgtccggcttgccgcgtgcggcgcagcggtagttgccgctgtgtgcctgtttgaatgcaatgttcgtcattgcgtcacctccttcaaccctatgccggatggaggtgaaaattgaccgtgaatggtcaacttttttgaaattttcaaaaaaagtttttctgcaccgacccagcggggtactcgaactgcgtcagcatgttcgcccctaacagggcgactcctttctctgcaccagctgagtggggcgcacgaactgccgcaggcgggttcgcccctaacgggcggctccttttctgcaccggctgagtggggcgcgcgaactgcgtcagcgtgttcgccctgacagggcggctccttttctgcaccggctgagtggggcactcgaactgccgctggcgggttcgccctgacggggcggctccttttctgcatcggatgaccggggcgcacgaactgccgctggcgggttcgccctgacggggcggctccttttctgcaccggctgagcggggcacacgaactgccgcaggcgggttcgccctgacggggcggctccttttctgcatcggatgaccggggcgcacgaactgccgctggcgtgttcgccctgacggggcggctcctcttctgcaccagctgagtggggtactcgaactgccgcaggcgggttcgcccctaacgggcgggaagtttttcgctgaacctcagcggagagttgcgctctgcggagcgcgggaggttgccgcgcccgcggccggggcaaaaaggaagggacacctgaggtttcccttcctctttgaactcctacctttcccttgttgggatagcttgggtgcagacggtagactgcgtaagcaggaaaaggacgcggcagtcgggttacctcagcgtgtctttctccgccttttcgcagttcacagacagcgtactgctacacatgcgggttactcaacgcagagcgcggcatacccgtgccgcgcaaatccttggcacgttgtaacgcacggcacctgcgaggataaattgcaccgaacgcctaatccgtaggtgctgtccgcaaactccagacttacgagttgcgcggcacgggtatgccgcgcctgctggaagtagccgacctgtgtagcagaacggtatctgacactgcgaatatgtctcgacatgggagcacactgtgctcccctacggtagaaaaaatcctctgccgttccccttttcgcagcggtcacatgtcggtaatctgcgccagactatccaagggaaaggggtgattcacaagagggtggaaaccgcaggtgtctaccctcttgtgcgcccgcgcggcgtcagcgcactcccccgcgctccgcagagcgcaactccccgctgaatctcagcgaaaaacctcccgcccggatagggtgaaccgcgtgcgcggttcaagtcccccgctgggtcggtgctgaaaaagctgccgcccgttaggggcgaacacgctgacgcagttcgggcatcccgctcagccggtgctgaaaaaaactgccgcccaaaccggggcaaaaagccgccgtttgttaacggtatatcccttgtattttcccgtccggcttgatacaataggcttgtaagagaaaggaggcgtttacaatgaaacgctcaaaagttattacagccgtaattgcgatcattgcagtagtcgccgcagcctgtgtatatggatatgtccgcagcaagcccgccgatgagccggaaaagcctgctgttaccgagccggagaacccgaccacgccggaaacgccggacgacagcaattccggcaaaccgtccgattccaagaccgatgaacctgccgtacagccggaaaacccgaatccgaccggcacggagtccgtcaccatctatgttccggatgaacagggcgaaacgctcacgccgaccggcgcagacgcgaaggacgactccgaccagtcgctcgtggacgcactcatcgccgcaggctcgctgcccgagggcgtcaaagtgcagtcctcgtcactcgagaacggcacgctcacgctcgacatgaatgccgccttcggcgaggcgatccgcgcctccggcaccgccggtgaaacgctcaagatctacgcactggtcaacacgttcgcgcaggcgcgcggcgcaaccgcagtgctcatcaccgtggacggcaaggtgctcgaaagcggacacgaggtctacgattacgcgatcgagccaaacaactgacctgcaaaagaaaagctccgaaacacctgtttcggagctttttcttacttattcatcattttcaggaacttttccttgatatgcgcggctgccgcgcacggatcgtccgccttcatgacggcagagaccacggcgatgcccttgatgggactgtcggccagcacgtccatgttatccgcgttcaggccgccaatggcaaccaccggaatcgggaccgcgcggcacacatcgttcagcacggagaccggcgtaaccttggtggtaacgtgggtagtcgtcgggtaaatagcgccggtgccgaggtaatccgcgccgtcgttgtacgcggcaacggctgcttcaaccgtcttggcggtcgcgccgacgatcttatccgggccgagcagcctgcggcacacggcaaccggcaggtcgctcgcgccgacatgaacgcccgcggcatcacacgcgatggcgacatccacgcggtcatcgatgatgagcggcacgttatagcggtcggtgacggacttgacctgctgcgccagctcaaggtagctgcgtccgccggtgtccttctcgcggagctgaatgagcgttgcaccgcccctgcacgcctcgtccaccgcgcggagcagggtctcggtcgtgtggtaggtactgtccgtaatgacatataatgtaggatcaaactgcatgataatactccttttttgaacttattgtgccgtttcgcattcttttaccgtcttgcgaatgaaaaacaggctgataacatcaacaacgtaaataaactgggaaatgacctgcaggactgcggttccggtgctgattttgccctgcctgcgcgcgtgcaggatgagcgcaatgcagtagccggacgaggccatcatggcaaaccaggcaaccagaatttccatcagcacgattggtgcggtaaacacaaaaatcaccgaaaatacgccgtaaataatgccgtagaggaaatttacaagaaacatctgaatggcaatcagcttcatggacacaaccaatttccagattgttgaacgaattgcagggtcgttcagctgtttcttcacgcgcgctgccgcaatcagattgcagacggaaagcaacagaatcagcaggctgaacagaaacacgcccaacacaaaatacctgctcaatgcttctaatgactgactggcgtaaccaatatacgacagcgccagaccgacaaagcaaacgatttcacagatgctgaaaaactttgcagccttcatcccctctcccctttcaccgcgtgttaattttcatcaatttattttcacgataagcaaatcctgttcttccccgagttcaccgagcgcggtgccgtccggctgaaacgccatgctgtgcccgacaaattttccgggcgcatactggtctgcgccgagcacggtcaggccgttctcgatggctcgcgcgcacagcagggtgcgccagtgcagcagcttgttctcgccctgcacccagcccgccggaacgaacagcgtctcggcaccgcgtgccttctgctcggcggcaagcgccggaaaccgaagctcgaaacaggtaatgatgcccagttttccgacaggtgtctcgatgggcgaaaacggctcgtcccctgcccggcactcatcggattcccgatagccgaaggcatcgtacaaacggttcttgcggtgcgttccgcgcaggcggccgcggtcatcaagaaccgcaatcgtgttgtacggcaagccgtccgtgcgctcgtacatgcctgcggcaatccacaggccgtatcttcggcaaagctcaccgagcgcaataatgaacgcgccgtcacacggctctgcggcctcgatatttttcgaccgtgcgttcacttttgcgtaatacatgctgtattccggcaaaaacagcattttcgctccatttttcgccgccgtttgtgcaaggcattctattttcctgagattggcagttttgttctctccggcgctgaactgcccgatggcaaccgtgctcacgcctctctccagcccttgcagatgtccacccatgccttgaaaccggagaatttctccagttctgggatggtgacctcgatggctgagttggacgagccgcacgctgggaataccgtctcgaaccgtcggagcgattcatcgaggtagaccgttacgccgtcgttcacgccgaacgggcacacgccgccgaccgcatgaccgatctccggctcgacctcctcaaacgcgagcatccgcgccttgcagccgaaccgcgccttgtacttcgggttgtcgatcttggtgtcgcctgccgcaacgatgaggatcacgccgtcattcgtgcggaacgacagcgtttttgcgatgcgtgccggttcgcagtgcgcggcttcggcggccagctctacggtcgcgctggacaccgggaattcgatcacgcgatcctctgcaccgaactgacgcagatacacttttgctttttcgatggacatgggtctcaatctccttctgtctgctgcgggatatcgtcgatcatgctttcgcacagccgacgtaaataatttgcaatttcgctgagcgcaaggcatgtgcacagccgctcctccgggtcatccggcgtctcgggcagctgggcggtcagcagcggcggaatggcttcgcgcatgcgcttcttgtccgcgagcagatgctcgtagcacgccgcaaagtccacatcgttccgaccggtcagcgccttcacatcgtttaagcgcagcgtctgcttcaaatggtacacgcagagcagctgcatgatctgctggcgcgtgtattttttgcccttcaccggcgtcataagcccttccttgacgtagttgttgaccatggtttttgtcagcagcttatcctccggcgtgcgcttgctgcccgataagcactgatcgaacagcgtcagcacctgatccatatacaggtcaagctgcggcacctcgtcgggcatgatatcgcggtcggcaaagaccgcttctatggttttctccagccgcggcatggcgttcacctcatcttttacaaaatattaataactgcggtaccgaacggaaacacgcaatttttcgtctgcccgtgcggcctgcaatgctattattataagccttttgcacgcttcacgcaagagttataccgctcgacaaacccactgcaatatgatatactgaacggacaataagcggtaggaggcttacatatgaaaaaattctggcaacgcctgatccttttcggactgacaggtgcattttttgtatcctgcattagctgcagcgcggcaaatactgcctcgaaggttccgattctgatgtaccacaacctgacgaacgacccgtccgccgtgacgagcatgactatcaccggcgagcggtttcaggaggacatggaatatctggaatacaacggctacacgccgctgctctcggcggatttgatcgacatccgggccggaaaggaagccatgcccgaacggccggtcatgatcacctttgacgacggttatcgctccaattacgatattgcgtacccgattctgcagaaaaccggcatgaaggccgtcattgcactgatcggcaaaagcatccgcgcaaacgacaacacggaagcgaatcgctttttcctcaagtgggatgaggcagccgaaatggccgacagcggtctggtggagctggcctctcacacctacaacctgcacaacccgcagtacggcggactgaccgcaccggacggcatcaacggcatccagcggctgaagggcgagtcgcaggcggcgtataacaagcgtgtcggtgaggacctcaagcagagcatcgacctcatcacgcaaaataccaaccagaaaaacgtgctgtttttcgcatatccgttcggtgcgcgcgacgagtggatgcagccgctgctgcagaaacacggtatccaggtcagcgtactgaccaacaccggaacggcgtctatccggcgcagattgaccgatctgccgcgttaccgcatcacgatggataccaaactgagcgatattcttccggcgaacccgaacgcctcgcacgatattaccgtgcgggcgcacatgccgaccatgatcaagaatgagaaaatccggcaggaagtcgcccggcaccttcccgcgcaggagagaaccataaaaattccgaaatcgtatacctgatttttcaagggcagtaccgcataattaagcaagagcgatttgcgagtaaattttacggactgacgaggcgtggttttgcggtaatacttgatgtattaccgtgaaatcacaacaaagtcagggcataaaatttccgcaaagcgccgcagtcttaattgtgcggtattgcccaagcactgtctttgattaacaaagacggtgcttttttcatggtgacaatttggagaaagcacttgcattttccggaaaatatggtatcataacagacatgatatagttttcaactctacataacaagaggaggagtttgtatgcctcgtgcatttctcaaggcccgcgagccgttttccagttactctcatttcatcggtgcggtgctcagcagcgccggactgttcgtgctgctcgtgcggctgctattcgattcgtccgtcaccggctcgctggcggcggctgccgtggtgttctgcctgtcgctgatcgcgctgtactccgcaagcagcgtgtaccatttctccggccgcggcgaagccgtcctgcggcggctgaaaaagctcgatcacagcatgatctatgtgctgatcgcgggcagctatacgccgattattctcaaattcatgcctgtgccgcgcagctatgtctttctcggcgtgatctggctgattgcgctgaccggcattgccatcaaactgctgtggattgacgcgccgcgtctcatcggcaccgtgctgtacctcgcgctcggctgggcgattgcatttgatttcggggttgtgctgtccatgcctgcgcctgccattgccctgctggctgccggaggtctgtcgtatacggtcggcggcgtgatctatatcgccaaaaagccgaatttaggtaaaatgatcgggtttcatgagctgtttcatctgttcgtaatcgtcggcagcgtttgtcattatctgatggtgtttctatatgttctctaacaaacgagccgtgaatcttcatgtgattcacggctcgttttcgttttcatccgcacccgacaaaccattcggcaaacggtttgattctgtattcattttccatcctcaattctcaattttattccttcctattgacaaaagaataaatctacaatatactcttaattaggatagaatactaataaaggaggtgcattttatgcagaccagaaacaccattcagcgtcagatcgtattgcaggcagtgaatcagatgcacaaccaccctaccgcggatgcgatttatgccgttatcgcggcgcagcacccgaccatcagcaaggccacggtttaccgcaatctgaaccagctggcagctcagggcgagattttgcgcgtgcctgtgccgaccggcgccgatcactttgatttcaacatcaagccgcattatcatgtgcggtgcaccaagtgcggcggtgtttttgatgtatttatgccgcctgtcaccgatctcatcgaccgcgtagaggattcctccggcgtggagctgcatcggtacgaaattctgtttgagggtatttgcggcgcttgccggaaagactaaaagagcagtcagaacggtctgaccgtcaaccggaagaatagcggagaaaggataactgttatggcagaactcaagggcacccgcaccgaagcaaacctgcagaccgcatttgcaggcgaatccatggcacgcaacaagtacacgttctttgcctccaaggcgaaaaaggacggctatgtgcagattgcgaaaatcttcgaggaaaccgccgcaaacgagaaggagcacgcgaaaatctggttcaaactgctcaacggcggcattgacgataccgcagccaacctcaaggctgccgcagagggcgaaaactacgagtggaccgacatgtacgccaccttcgccaaagaggcgcgtgaggagggcttcgaccacatcgcggatttgtttgagatggtcggcgcgatcgaaaaggagcacgaggaacgctaccgcaggctgctcaggaatgtcgaggataagctggtcttttcccgcgacggcgactgcgtatggcagtgctccaactgcggacatatcgtggttggcaaacaggcgcccgaggtctgcccggtctgcgcgcatcctaaagcctactttgaactcaaggctgacaattactaattgaaaattgagaatggagaattgagaattgcggtatcgcgcaagcgcgatgattgaattgccgcccattgggcggaataactccatccacctcaataatcgcaaaaaacgagggagaaccaaccgtttctccctcgttttgtcatttgaacatcaatgaaccaatgaaaaatgaaccgaaacccgtttgaccgtcgcgttcattctccattctccattttcaattttcaatttgcgttccgcactgcgtccttcatgctcttgacgtactccttgacgtgcggaacgcagtcttttccgtactttgcacagattttgacgattgccgagccgacgatcgcgccatctgactgggcggccatcttggcggcctgctcaggtgtggaaatgccgaagccgaccgcgcacggaatatcctgtgtctccttgaccagcttcaccattgcgccgatgtcggtggtgatgctcgagcgcacgccggtaacgccgagcgaggacacgcagtacacgaagccggaggcttcctttgcgatcatgcgtatgcggtcgtgcgaggtcggcgcgatgagcgacacgaaatcgaggccgtactgacggcacagcggatcgaactcggccttttcctcgaacggaacgtccggcaggataagaccgtccatgccgatctccgcggcagtgcggatgaaacgctccgagccgtaggagtacaccacgttcgcgtaggtcataaataccatcggaatgtcggtcttttggcggatgcggcgcaccatgtcgaagattttgtcggtggtcgtgccggcggacagcgcacgcacattcgcctcctgaatgaccgggccctcggcggtcgggtcggagaacgggatacccagctcgataaggtccgcgcccgcatccgccatcgcgtatacgatctgctcggtgacgtccagagacgggtcaccgcaggttacaaagggaatgaaagccttgccgctccggaaggcagatgttatcttgctcatagcttgctcctttttcgtagggcgtgacgacctcggcacgccgatggtaacgatgtgcatacggcctgcatggcgcgccgagtcgtcgcgccctacggcatatattcaaaaacgatgcataaatttcctaatcactcatgaatatcctcgccgcggtagcgtgcgatcgccgcgcagtccttatcgccgcggccggagatattgataacgatggtctggtccttacgcatggtcggcgcgagcttcatcgcgtatgcgactgcgtgcgcagactcgatcgccgggatgatgccctcgatacggctgagatactcgaatgcatttaccgcttcgtcgtccgtcaccggaacgtactccgcgcggccgatatcgtgcaggtaagcgtgctccgggccgatgccggggtaatccagaccggcggagatggagtagaccggtgcgatctggccgtattcgtcctgacagaagtagctcttcatgccgtggaaaatgcccagacggccggtagcgatggtcgcggccgtttctgcggtattgacaccgcggcccgcggcctcgcagccgatcaggcgcacgccctcatcctcgatgaagttgtagaacgcgccgatggcgttcgagccgccgccgacacaggccatcacgacatccgggagtttgccctccttttcgagcatctgctccttgatctccttggagatgaccgactgaaaatcgcgcacgatggtcgggaacgggtgcgggcccatgcacgagccgaggcagtaatgcgtatcgtcaatgcgggaagtccactcgcggaaggcagccgagcaggcatccttgagcgtgcccgtgccggtcgaaaccgggatgacctccgcgccgagcaggcgcatgcggtacacattgagcgcctgccgctcggtgtcctccacgcccatgaacaccacgcactccatgcccatcagggctgcggccgtcgcagtcgcaacgccgtgctgaccggcgccggtttccgcgatcagacgggtcttgcccatctttttcgccagcagcgcctgaccgagcacgttgttgatcttatgggcaccggtgtggttgagatcctcgcgcttgaggtagatcttcgcaccgccgaggtcgtttgtcatgtgctccgcaaagtacagccgcgacggacggcctgcgtagttgttcagcagctcggtcagctctgcgttgaatgccggatcgttcttatagtggttgtaggcttcttccagctcgatgaccgcgttcatcagcgtttccggcatatactggccgccgtgtacgccaaaacgtcccttgctcattggtttgctcctttcacgagcgccgatacgcggcgcatcttgtcaatatcctttacatcgtccgtttcaatgccgctggacaggtcgagcgcatacgcgccggtctgtgcggctctttggacgttactttcattcagcccgcctgcgagaaaatacgggtggtttaccttgccgatcagcgaccagtcgaacgtcttgccgctgccgccgtaggcgtgctttacataggtatccagcagcagataatccaccgacagcttgtccgcctgctcaatatcgcggtgcgtttccacgcgcacggcgtagagaatgggcgcgttcgtcagctttcgcagcttctctatataatgcacgctctcgccgccgtgcagctggatgatgtcgatgacttcatcgcgcacgagcgcggcaatatgctccggttcgtcgttcacgaacacgccgaccgtcttaatctccgggtcgaggtgctccttgagccgcgccgcatccatatccgacacatgacggcggctctccgcgaacacgaagccgataaagtccggtttggtttcgttcgcggcctctatatcctctttgcgggtcagtccgcagaatttcagtttcattttgtggcctccctgagtgcgtcaagcgcctgtttcttgtctgcggcacgcatgaggtactcgcctaccagaacggcatccgcgccggtctttcggagtgccgccgcatccgccggagcggaaacgccgctctcggctacgaaaaccgtaccgtccggtgcgccctcgcgcagacgagccgcgttgccgaggtccaccgtgaagtccttgaggttgcggttgttcacgccgatgagccgcgcacccgctcgaaccgcggactgcatttcctgtgcatcgtgcgtttccaccaaagcgcttatgcctaatttgtcgcaaatgccgatgtaatcgcgtatcgtttcggtgtcgagcagcgtgcaaatgagcagcaccgcgtccgcgccgaggactttggcctgataaatctggtactcgtcaaccgtaaaatccttgcgtatcatcggctttgtgacgattcccctaaccttttggaagatttcgtccgagccgaggaaccacttgggctcggtcaggcaggaaacgcagtccgcgccggcgtcctcgtagctttgcgcgattttctcaaagtcgaacaccgggtcgatgatgcccttggacgggctggccttcttgacctcgcagatgaacgcgcagtccttacctgcaagcgccttctcgaatcggaaatcgccctgcgggagtgcttccgcctgcgccttcatgtcctcgagcgaaatcttcgccttgtccgccgcaacgcgctcgcgggcgtgcgccgccagttcgtcgaggatcatgcctttgccgcctcctgcgttgccgccgcaaaccggtcgagctttgcgagcgccgcgccgctgtcgatgagctcggcggcctttttgatgccgtccgccagtgtcaggccgtccagaccgaggtacagcgcgataccggcgttcagcaggatttcctcgcgctttgcgccctgctcacggcctgcaaggatgtcgcgggtgatctgtgcgttcgccttgggtgagccgccacgcaggtcatccaccgtgcacagggacagaccgtattcggtcgggtcgagttcatacggcgtcagcttgccgtcgcggatttcgcagaccttgttcctgccgatgaggctggcctcgtccataccgccgccgcagaccaccatgccgcgcgttacgccgaggttactcagcacctgcgccatcggcatgacgaggctttcatcgtacacgccgagcagctgcatagttgcgcgcgccggattggacagcgggccgagcacgttgaagatggtgcgctcgcccatgcccttgcggacaggcgcgacgttcttcatggacttgtgatagccctgtgcgaacaggaagcagatgccggtgtccgcgagcaccttttcgttctgctcgggcgacagcgacaggacaacgccgagctcctcgagcacgtcagccgcacccgacttggacgaaaccgaccggttgccgtgctttgcaaccggcacaccgcctgccgccgccacgaatgcggcagttgtggagatgttgaacgagccgacctcatcgccgccggtgcctacaatatccatgaccgctcccttcggctcaatgtgcgcgcccttttcgcgcatgacctcggcgcaggccgtgatctcggtgatggtttcgcctttcatacgcagcgctgtcaggagcgttgccatttcaatgtcggtcgccgtgccgtccatcatttcctccatcgttgcacgagcgatagtgtagtccagatcgcggccgttgatggcctcgtgaattgcaagctgaatcataattcgtacctcttttataaatgttaaatctctaagtaattgaaaattgagaatggaaaatggaaaatgtcgctatccttgcgcgagttccgtccgcgctgcgacaagctatccttgcgcgagttccgtccgcgctgcgacaatgtgcggcgctctgcgcgataccttaattctcaattctccattctcaattctccattttcaaaaagttctgcataatggttgttccctgcggtgtcaaaatggattccggatgaaactgcacgccgtaaatcggcatggtcttatgctttacggccatgatctctcctctttcgtcgcgggagataaccttgaggcactccggcagagaatccggtgcagcgaccagagaatgatagcgcgctgccatggtctttttcgccagacccttgaacagcggctcttcggtatccacctcgacgatgctctgcttgccgtgcatgagctgctgcgcgtgctcgatgcggccgccgaacgcctcgcagatggcctgatgaccgaggcacacgccgaggatggggatgctgccgccgagcctgcttaccacttcctcgcagatgcccgcgtccttcgggtagccgggccccggagaaaggatgatgtgcgaggggttcagtccctcgatttcaccaatggtgagcgcatcattgcggacaacgcgcatatccggctcgatggccgccgcctgctggaacaggttataggaaaaagaatcgtaattgtcgatcaggagaatcattatccgtctacctccgatgcacgctcgatggcattcatgactgcctttgccttgtttgcgctttccatatattcattatgcggcacggaatccgcgacgatgccgccgcccgcctgcacggtcacgatgccgttcttcttggcagccatgcggatggcgatgcaggtatccatattgccggtgaaatccagatagccgagcgcgccgccgtatacgccgcgcggctcactctcctgctcctcgatgatctcgcacgcgcggatcttgggtgcgccggacagggtgcccgccggaagcacggcttcgatggcgtcgcaggcgtcgtacttttcgtcaatgtcgccctcgacctgcgagcagatgtgcataatcttggaatagcggtggatcatcatgtaatcggtaacttcgaccgtgccgatcttggaaactctaccgaggtcattgcggcccagatcgaccagcatattatgctcggaaagctccttctcatcggcaagcagctcgttttcgagcgccttgtcctcctccggcgttttgccgcgcggacgggagccggccaccgggaaggtggtcaggcggccgttatccagtcggacgagcgtttccggagaggaacacatgatctcgtccccatcaatggaaaggaacaccatgtacggcgaagggttggtggtgcggagcacgcggtacgccgaaagcaggctgtcctgatacggactggagaactgccgcgactgcacggcctgaaagatatcgccgtcaaagatgtattcgcgggtcttttctacgatatcggcgtactgcgcctcggtgacgttgcaggtgaagctcggcctgccggttgccttgagcggcggaagcggactttggtcgttgatcagcgccgccatgccctcgagcgccgcacacgccttgccgtaattctccatcacgctgtcggtcttcatgttgaccacgagcacgatcttctgcttgaggtggtcgtacgcgatgaccttgtcgaacagcatcaggtcaaaatcatcccatgcgccgcgcttgatattgagggtcggctctgcgtagccgagcatcgcatacgcgaagtagccgacgaaaccgcccgtgaacggcggctgaccctcaagccgcggtgcgcggtactcgccgagcacctcgcggagaacggtgagcggcttgtcggtcttgaccgtcttgttgaccgtaccctcgagcgttaccgtgccgtttttgcaggtcgcacgcaggatggggtcgtagccgagaaacgagtagcgcgcccatttttcgccgccctccacgctctccagcaggaaaaagcggtcggaacgggtctgcaggcggcgcagcagcgaaatcggcgttgtcatatctgcgtagatctcgcggcagaccggaatggtcgtatattcctccgcgagcttcaaaatctcgtcacagcctggggtaatcattgtgttttcctccatttacaaacaaaaaaggcttctgtcctcacgatgcaaatgcatcatgggacaaaagcctgttacttctgcggtaccacccaaattgacgtacaaaaacgtccactctgtcgtgtgcaaacacacacgctcccttgataacggcgggattcccgtcagccatactctcctttcggatttgaggctgccctcacaagtccattcagcaacgtcctttgctgctctcctcacaccaccggaaagctctctggaagcacggtctcgctcttactcactcttgttctgcggttttgcaatttctgaaatcagtatattcccacgatgagaatttgtcaagttgattttctgtgttttttctcaaagtcctactttttctctatgttatttcgcaatgggatacgacgggcacaccgcaccgagcggacagccctcgcacctgggactgcgggcggtgcagtgctcgcggccgaacagcaccagccggtggcagaaatcggacgactccgccgggtcgagcagctttctcagggcgttctccaccttgaccgggtccttctcgttcttgacgaagcccagccggttggacaaacggatgcagtgcgtatcgcacacaatggccggtttgccgaaaatatccccgaggatgaggttggcggtcttgcggccgacgcccgggagcttgagcagctcctccatggtatccggcaccctgccgccgtaattggcgatgagcatcatggcgcacgccttgaggtcgcgcgctttggtgcggaacaggccgcaggtcttgatggcctcggcaatctcctcctcggacgcatccgcgaagctctgcagggttggaaactgcttgaataatttttctgtcacaatattgacgcgcgcgtccgtacactgcgcggaaagccgggtggcaaacagcaattcataatcgtgtgtatagtgcagggcgcagaccgcctccggatagaccgatttcagcagctcggtaacggcggcggcacgttctttcttggtcattgtgttatcctctctccccaaataatcctactgatattgtaacatatcgtcgaaaaaagggcaactgtttgcacaaaaatgcacaatgtaacattttcactataaactgctaaagcgttaacgcaaaaatcagatatttgtcaatagattccatgcgaaaaatgtggtttaattataatagtaaattcttatcgtacaatatcacaatattgttctatccccgcaggaggctgtatcatggttcgtgaagcaatggatttcgttacggcgttcgatcccgaactcggccgtatgatcgaagcagaatacaaacgacaggcgcgcaacattgagttgatcgcctcggaaaacatcgtcagcgaggctgttatggcggcaatgggcagcgtgctgaccaacaagtacgccgagggctatcccggcaagcgctactacggcggctgcgaatgcgtcgatgaggtggaaaacctcgccatccgccgcgtgtgccagctgttcggcgcgaaatacgcgaacgtgcagccgcactcgggcgcgcaggcgaacatggcggtctatcaggcgctgtgcaagccgggtgataccgtgctcggcatgagcctggacaacggcggtcacctgacccacggctcgccggtcaatcagtccggcctgctgtacaacatcgtgccctacggcgtggatgagaacggtctcattgactatgatgcgctccgtgcccttgcaaaaaaggaacagccgaagatgatcatcgccggtgcgtccgcgtacccgcgcgccatcgactttgaaaaattcgctgaaatcgcacacgaggtcggcgcgtacctgttcgttgacatggcgcacattgccggtctggtggctgccggtctgcaccagagtccggttccctacgcggatgtcgtcaccaccaccacgcacaagacgctgcgcggtccgcgcggcggcgtcatcctgacgaacgatgaggaactggcaaagaagtttaacaaggccatcttccccggcacacagggcggcccgctcgagcatgtcatcgccgcaaaggcggtctgcttcggtgaggcactcaagccggagttcaaggcgtaccaacagcgcgtcgtcaccaatgcccgcgtgctcgcggacgcactccagaagcagggcttcgatctggtcggcggcggcacggacaaccacctcatgctcatcgacctgcgaaagaccggcgtgaccggcaaggagctgcagcgccgtctggacgaggtgtacatcaccgccaacaagaatgccatcccgaacgacccggaaagtccgttcgtcacctcgggcatgcgcatcggcacgcccgctgtcaccacccgcggcttcggtgcgccggagatgctccgcattgccgagttcatctggcaggccgcaaccgatttcgacaacaaggcaaacgatatccgccgaaatgtacgcgatatctgcgcaaattttccaatttactaacaatttttgccgactccctactgttggagtcggcttttttgttagatttgttcggtttgcataatgcaaaattacctgtcagaaaccgtcgagcagataaagtttttgtaaggtttgaacaaaatgcttgcctttttccgtcagtatgctatacttagatacatgagggagagcaaatcccgccaaatggcttggaggaaataacaaaaggggaaatgcagtaatgggaattaaactgaaactgaccggtctccggcgatttgtccggaccgaggctgagattgcggactacaccgcgcaggtagcggcagcgcaggacacgctcgtgaacggcaccggcgccggaaacgattttcttggctggctgaatctgccggtggattacgaccgggacgagtttgcgcgcatcaagcaggcggcaaagaagattcagcagatctgcgatgtgctgatcgtcatcggcatcggcggctcgtatttaggggcacgggcagccatcgagttcgtaaacggtcagttctacaaccaggtccgcccggagggcattccggaggtgtactttgccggcaacaacatttcgtcgtcctacttaaacgacattatcaagatgatcggtgaccgcgatttctgcatcaacatcatctcgaagtcgggcacgaccaccgagcctgccatcgccttccgcgagctgaaaaagctgtgcgaaagcaaatacggcaaggagggggcgcgcgagcgcatcttcgccacgacggataaggagcgcggcgcgctcaaaaagctggcggatgacgagggctacgagacctttattgtgccggataacatcggcggccgtttctcggtgctcacgccggtcggtctgctgccgatggctgcagccggtctggacattgacgcggtaatggcaggcgctgccgccgcccgcgaggaatattctcaaggctccttgcacgactgcgcgcgctatgcggcactgcgtaatctgctgctgttcaagggcaaatccatggagatcatggtaaactacgagccgtcgctcgtcatgctcggcgaatggctcaagcagctgttcgatgagtccgagggcaaggaccataagggtctgttcgtcacctcagcgaatttctccaccgacctgcattctatcggtcagttcattcaggacggctcgcgcatcatgttcgagaccgtgctgtgggtcaaggaaccgcgctccgagattaccatcgagcataccgaagaggatatcgacggcctgaattatctggcaggtcagaccgtgcagcacgtcaaccagaaggcgtacgagggcacgctgatcgcccacatggacggcggcacgccgaatatcatcctcgagatcgaccgcacggacgcctggcattttggctatctggtctactttttcgagaaggcctgcggcatttcgggttacctgctcggcgtaaatccgtttaatcagccgggtgttgaggattataagaagaatatgtttgcacttctgggcagatcgggtttcgaggagcggagaaagtaccttgaggctcgtgtcaagctggaagactgaatccctttgctgtattcaaggagagagcgttgtgctctctccttttttattcttcgcaaatggagaatggagacacccaccgcagtgggcgtccagcgagcaaccgccgtaggcggctcttagcgagtcggaattgagaatggaaaatgaacgatacggttttatttgttgcgggcgaccagtggtcgcccctatggtaatgcgtgtgcataccgccaacaaagggcacgcattgcgcgtccttgtaaaccatatgcaccgataaaccacacaatggaaaatgccaaatctccacgttcattctccattctccattttcaattctcaattactccacccctgcgtaaatcccgccattccgggcaaaataaatgcggtgatgaaaatgaaactgcaaactcccgcagtctttgcgctgggcgcggccggctacgccgcgcttgagcttctctggcgcggacgcacccactggacgatggcgctgaccggcggtgcggttctggtcggtctgcggcggctgcggcggcgcgtacacgaggaaagcccgctctcccgctgcctgtgcggcgcggcatgcatcacggcggcggaatatgtggtcggctgcacggtcaaccggcatttccggctgcgcgtgtgggattactcgcacgaattcggcaatgtgcaagggcagatctgcccgaaatacgccgtgctgtggacgctgctcgccgcgccgattatgctgccgaaataagacgaaaatgtgtacctctccccttgcaatacggtttttaatgtcttataatagtgataaactatgcagaaaaggagacacaccatgctgatcgcagtcaatgcaggaaacagccgcgttttgctcggcggctatgaggaggacggacaggttttttctgcctccatcgcaaccgagcctaagctgacgcgcgacgactacgcctgcaagctgcagcaggtgcttttgctgtacggcgtgaacgtgcgccgcatccacggcggtattgtcagctcggtcgttccgagcatggtcggcgtgctcgagggtgcgctgcgcctgctcggcatccgcgatgtcatcgaggtatcgagcggcgtcaagaccggactcaacatccgctccgagcagccgcggcaggtcggctcggaccgcgtagccgctgcggtggccgcccgtgccaagggaaagctgccgtgcgtggcgattacgctcggcaccgcgaccacgttcaccgcgctcgaccagtccggtgcgctggtcggctcggccatcacggcgggcgtgcagctgagtctgctcgcgctccgtgagcaggcagcgcagcttccggcggtcgccatcgacgccaaggacgagggcattctcgcccggaacacggtcgatgccatgcgcgtcggcgcggtttacggtgcggcgtcgctcgtggacggcatggttgaacgctttgcggaagcgctcggtgaaacgccgtatgtcgtgctcaccggagagcttgcgccgctcgtcactccctatctgcgtatcccgttcgagtacgatgaaagccttgtgctcgacggtctgcacctgatttggaagaaaaatcggggttgaaaaagatttggcagcgaatttctatcgctgaccaccacaatttttgtattgcgctgtacctgtcaaagcaggacggcagcaggaggaattacaaatgaataacaaaactaccaatgtacggtatctcgcgcagctggcgctgctggcggcgatcgaggtcgtgatgaagctgatgggtctgggcagcgtgccggtcggtccgctgtacatgtcgttcctgaccgtgccgatcgctgtcggcgcgatgaccatgggtccgaccgccggtgcgattctcggcggcgtgttcggtctggtcagcatgaaggacgccatcaccggtgcgtccgttatgaccggtgcatttttccagatcagcccgatcaacaccttcgtgctgtgcgttgtcatgcgcgtgctgatgggctggtgcgtcggcctgctgttccgcgtgctgcgccgcgtggaccgcaagaagagctggagctatttcgttggtgcgctgtccgcgccgctgctgaataccattttcttcatgggttacatcgttctggtgttctacaagaccgactacattcaggagcgtgttgcctctctcggcgtggctaacccgctgatgttcgtcgtgctgctggtcggtgtgcagggtctgatcgagatcatcgtcggctgtgcggtcggcggcgtgctcgcccgtgcggtagcatcgttcctcggccatcgtgcgcctgcaaaagcagaataaatgattgctaattgcggcagtttctctcatttttcgcagagaaactgccgttttacgttcccggaaaacctttccgcgcccagagaatttccgtgccgccaaatgtccggcagaatagaaaaggttcacagcgttgttttcatgctccgcgcggcatagtaatagcggaggtgaaaaaatgcaaaaaaatcacgcaaaacgcacggcgctcgctctgttcctgctgtttgcggtgacggtctccgcgcaggcggcaaaaatcgccgaggtcatcccgatcgggcacacggtcggcatcaaaatgcaggcggagggcgtgctcatcgtgcagctgaccgaggtgcagggcgcggacggcacgcactcccctgcgaaggaggcgggcgtgcgggagggcgatgtgctgtgccgcgccggtgagaccacgctgcactcgaacgacgatctgcagaagcaggtcgcgctctcggcgggacagccgatcaagctgacgctcgagcgcggagacgcggagaaaagcgtcacggtgacgccgtgcagggacaaaaccggtgcgtaccgcatcggcgtgctcgcgcgcgacagtctggcaggaatcggcacgctgacctacgttgacccgcagaccggcgcgttcggctcgctcggtcacggcatctgcgacagcgagaccggcgtgctgctgccgctgcaggagggcacgatcattcactcgacggtgagcagcgtgcagcgcggcaaggcgggtgaaccgggttcgctgcagggcgaattttcgaccgaaaaaccgcttggaaccgtggcgcagaacacagaaagcggcattttcggcaccataacggatgattcactgtacagcgagctgcagtgcgtgccggtcgcgtcggcagacgaaatcaaaatcggtgacgcggaaatcctgtccaacgtggacggcgacagcgtgcagcgttattctgtccagattgtcaaactctatccggcgaacgacgaatacgggcgcagcatgatgctccgcgtgaccgattcgcagcttgcggagaaaaccggcggcatcgtgcagggcatgagcggcagtccgatcctgcagaacggcaagctgatcggcgcggtaacgcatgtgctggtcgataatccgatggaagggtatggcatttcgatggagaaaatgctggcggcaagctaaaattgagaattgaaaatggagaatggaaaatgccgctatccttgcgcgagttctgttcgcgctgcggccgtaatgggtttgtctggcgtttgggcggccgttggccgccctcttttttatctttctgaaatgcttctctcccctatttgattgattttgttgtcgaaaaccgcagttttgcttgtattttgtctatttccagggaattttgaaaatatgcagaaattgcaaaaacagtcggtctgaccggtcatttcgggtaaatcgacagattttgtcgaatgctgtctgcaattttctctccaaatttttacaaaaggtcttgcaagttatggtagtatatggtaatctattgccaagaaaaagagatgaaatttatcggaaagctggttatgatatatgaatgagaaaatgagaattttacttgcagacgacgacaccgaattttgcgcgcgcatgtcggcggtgctggacagtgcggacgattttgagctggtcggcattgcggaaaacggcgaaaaggcactttccgcggtcaatgagctgcggccggatgtacttatcattgaactgatgctgccggtgatggacggcatgagcgtgctcagccgcctgcacgagcaggacggaccgcatccggcggtaatggtattctcggcgtttgcaagcccgcagatcggcgcggaatgcgcggcgctcggcgtggatctgttcctgcgcaagccgatggagccgcaggcggtctgcgagcggcttcgcctgtggcggaccggtcagctgcgtgcggtcaaggccgaggaaagcatggcgcttgagctccgcgtgaccgaggtgattcatcaggtgggcgtgccggcacacatcaagggttaccagtatctgcgcgaggccatcatgatggcggtcgaggatatcgaatcggtcagcgccatcaccaaggtgctgtacccgtcgattgctaaaaagttcaagacgacctcctcccgcgtggagcgcgccatccggcacgcgatcgaggtcgcgtgggaccgcggtgacatcgagaccctgcagaattacttcggctacacggtttcgggcgtcaagggaaaaccgacaaacagcgaatttatctcgatgattgccgacagactgcggctacagatgcggtttggggcgtaaagcaaatttacaacgcaagaagcagtaatatcattcagaaaacgatttgtcggtatagtatgcgtactatttacgctgttatgtgaatcgcagtaaatcacttgcaagcctgccaacatagtgaaagtgtgagtgaaacgcaggttcaagcctataaactttttctgatattgtgaataaatgaactaatttatctgtatcctttccaatgaaaaaccgcagcgccctctcgggcgctgcggttttcaggtgatatgcattttccttatgtcaaatcaatgagccaatctcgggcggttccggctttttcggctcgttacggttttccacgccgagaacctctgcgcggatgtcctcctcgatctccttcttgctgcggcggcggtccagacgcgaaatatacagatacttccggatcacgaacaggatgccgatcgacagcacggcgatcaggttctcgatcggcgaggtatgctcgacgatcatctgacgcgcgatggcgaggagcataacgtcaaccaccgagtcgatggtgtagctggtgatcatcttgatcagctcgatgccgatgatgatcaggcaggccgagctcatgcgcgcctgcagatacgccggatcaccgaacagcttgttcatatcggtcatagcgaccatgccgatgccggacacaatgcacgcgatcaggatcaccatgccaagggtgatctcaaccactgttgcggcattggagagcttgtctcgaaaatcagaattcatggcagtctccctttctctactcctcatttttacattcccttttctgcagttttgtaattttttatcagtctgtgtctcattccttgatataaatttaacatggtttttacgccttgtcaattattttaacaacttttgtatggtttactggtttctcacaagttttttatgcactttatcctcattttagttattttgcataataactttttatttttgttgtgagaaattatttgcgtttattttttgacaaacttatcattgttaagctataataatattagagtaaaccaataaaaaggcaatgccatgcaatcaaaggcactgcaaagaaaattctttgaaacggggtgggcaaatggctaatccgctgttgcagcactacatcaagctgacagaatttctcggacaggcacttggaccggattatgaggttgctctgcatgatatgaccgacaaaaatcgctccatagtagccatcgccaacaatcacatcagcggccgggagatcggcgcaccgcttaccaatgtggcgctcaaaatcctgatggacaaaagctacgaaacgcaggactaccgcctgcactactgcggcctctctgccgagggcaaaacgctgcgctcgagcacaatgttcatcaagcacaacagcaagctggtcggcatgctgtgcatcaactttgacgacagccggtatctggccgccagcgaaaacgtgctgcggctgtgtcatccggatatttttatcgacgaccatatcgcaccgcagcagaccgaacccggtgatccgttcccgcgagcggttccggcaacgaccgagagcttccacaactcgatcgatgcggtagcaggcgatgcggtcggccgcgagctcatccgtctcggcgtgaccgccgaccgtctcacgccggacgagcgcatgcagatcattgcttcgcttgaaaacggcggtatcttcctgctgaagggcgcggtcaaggatgtggccgacgcgctgcactgctcgcaggccagtgtgtaccgctatctttcccagattaaaaaggacgacagcaattccgcttcggaataacaagattaaaactcaaacggcaaaaccggagcgaaattcttccgattttgccgttttactttacctcgctttagtctgatagcaggaggatgctctcatgtttcaaaattacatgcgtcggttgttctggctgattctgggtgttgcggtcagttcggtcggcattgcaatgatgctgcaggcgaatgtcggacttgagccgtggagcgtgctacagcagggcatgtcactgcgaaccggcatgacctacggcacagcgtctgctatcgcaggcgcggcagccatcctcacggccgtgctcttcggcgagagcttcggcttcggcacgatcatcaacattgcgggctgcgcggtcataatcgacgcgattcaggcggcacacctcatcccgcagatacacggattggtgagcggcattgccatgctcatcggcggtctggagctgcttgcgctcggcacctggctgtacatgaaaagcgcgctcggcagcggcccccgtgacgcgctgatggtcgcgctcgcgcgtaagttcgggcggtctgccggcgcgtgccgcgcagtcgtggatgtgctcgtaacggtcatcggcttctttctcggcggtccggtcggtgtcggcaccattatttccgccgtcggactgggtccgctgatcaacctcaattttgcagccgtgcggttcaatcccgccgaggtgcatcaggagaatgcggcggaaaccattgcgaaaattgccggaaagcggtaattctcaggcagaagggtgtaaagtcatttcttatttgcgaagttgcacagctacatcggcacgccgtcctccatgattttgaacccaaaccgctggtaaaacgcagcgtttttgctctcctcgggcatgatttcgatatattcgctgttatcgagcaggcgcatgagaccgaccagccggtcgccgtcccatgcggcgttccccctcctctgccctatcattataccgaatgcgcttgcgcgtcacaagttgctattcaatttatgagtaacttttcttttgcatatgcacaaaattctcccgtaaaaacacaaaaaccgcccataaggacggttgattgacaggatattgtccgcatgctataatcaaatcagcaaacggtgaaaaaaggttgttcctctcttatcaagggaggtgatctggatgtcaatgtcagaagcgttgctgcttttccagttgatcaccacgatcgtctttggtattcttgaatacttaaagaaataaccgccccgtagaccggagcggcgtttcctcaaatacttcagctattaggaacgaccgctcggtgcaaacgagccgccgtttgtagctatattatagcgcggcgccccggttttgtcaagtgacagaaccggggctgctgtttttcacgcttttttacaaaatcacatattctgtgcccgataatacggaaccgggtctgtcgtgccgaacaggccgatgccgtccatatcctcgatgagcagcgtatcatcggttttgctgacatacaaattcagccaaatatcgtcgccgctatcggctatggactgacaccagtcgggcaggctccctaccgcctcggtatcgtacagcgtgaacgcaaccgtgtacatatcgtactgatcggacggatacgcctccggatagtaatactcattggggtcgtcgtacagacaccacgcgccggccgtgctcttgaatgtgccgccgtccgccgaggtatacagaatcgcccattcgtcgttcgactggtcgtagtgcagacggaaggtatcgctgttatcaaccactatgccgctgtccatgccgagaatgctgctgaggtcctgctcctcatcgctgtaatccgaatcatactccggcgcaggggcatttccgaagctgctctcgatctccggcaccagatcatccaccacaaacgcgaagatagccggtacgatctgcagcagagcgataacaattatcgcaatcaccacaccctttgcgctgtttttcttcggcttatccttgatgggacgcaccttgctcttcgccgttttcaccgagctgctgttctcaatcgtcggatgatattcggtgtaggtctcgcgcggcttgccgtgccatttcggttcgggtctcgtcatgcggcccttgctgcccgcgcgtgcgccgcacatcggacatacgcgttcctcatcgtcaaaatggataccacagtgctgacatttcacaggacacacctcccttttactattttaatcataccagagatacgccctgatagcaagcaaaagagcacaccgtttggtgtgctcctgctaattattcaaggtttaatttatgcaccagaatccaccgcgtaacgaggaaatacaccgcgtcgctgatcagtgcgaatacgcagcagaaccgcagcatgagatgcgctgcgccgatcggcgtaatgccgctccaccagactttcatcaggtctacgaacggctgcggcacggcattgcccgcacccatcatcaccataagcatgagaacctgcagtgcggtagaaagaacaacgtaccacacgatcgacatgagcaggcggtgacggcttgccagatgaccgagcgcaatgcacatatagaggaacagcgccatgcccgcaatgccgaggacagccagcacgagcagctccagttcaaacaggaattcctgaccgctgtgcggcagcagagtgctcagaccggtaaaagcctgccacacctcatccatcgacagaatcatcctatccgcaaaaatgaagatgctgatgagcgccgacagaccgctcagcgcgatcataaccaccgcgataatggtcttgctgagcaggtgctgcgaaaccgtgaccggcagcgtgaacatgaggtatccctcactgccgagcaggtttttgtaaaaacgctggatgagaatgaccgccgttaccacaaatgcggccatcatcacgcccatatacagcatggagccgatggcgggcagcatgaaatccagtgatgcattcttcggaatgacatacagtatacggctgataagcgacatgagaatcagcacgccgtacagcggcagacaggtccgcgcgcaggctttccactcatatttcagcagctttaacatgcaaacacctcccggaacagggcgtcaaccgattttccgtgctcctcacggatatggtcaaccgtgtcgtgcagcaccatcgcgccttccttgaggaaaatgacctcgtcaagcacacgctccacatccgcgatgaggtgcgtggacagcagaacggacgcgtcctcgctgtaattcgagagaatggtgctcagaatgtagtcgcgcgccgccggatcgacacccgcgatcggctcatcgagcacatacagctgcgcctttcggctcatcgtgaggatgagctgcactttctcctgattgcccttgctgagcgttttcagtcggttcagcgggtcgatccccagcgaatccagcatatcgtttgcctttacgcggtcaaaatccgtgtaaaaatccgcaaagaacgaaatcaggtcgttgaccttcatcgcatcattgagatagtttttgtcgggcagatagctgatgatactgtgcgtgtaggtgcccggcgcctgaccgtcaatgcgcaccgagccgctcgtcggctgcagcagaccgttcagcagcttgatggtcgttgttttgcccgagccgttcgggccgagcagaccgataaactgtccgcggccgagcgtcagattcagattattgagcgcggtctttttaccatagttttttgtcagtccctgacagataaccagttcgttgttatccattctttttttcctccccactgcgtttctccagaagcgccacaatgtcctgctcggtgaagccaagctggctcatgccggacagaaattccgtgatgcgttctcccgcgatttgctctcttaccttaccaatcatttctctgtcctccgttacatagcgtccgctcgtgcggttggtgaacatcaggccttcgcgctccatttccgcaagcgcacgctgcatggtgttcgggttgacacccgcctgagccgccagctcgcgcaccggcggtaccttttcacccgccgcaagctgtccgctgacgatctgctcggtcagcttttccacaagctgttgatagatcggacgatccccccgcaattcccattgcataagctctctcctttcgttttattgtattatgataataatacaaacatacagatttgtcaagacctgtttgtaaatatttttccggtgcaaattgagaattgaaaatggagaatggagaattattgtgatgggtaaaccagcgttttgagattaaactatcgtaaatcaaaacctaatatacatttatcgaaacacagcataaatttagaaatatcaccgcagggcggggtgccctccccccgccgtatcacacggttggtacaatctatcctgtaggggcgaacagtgttcgcccacacacgaccaacgataacgccggtttcgggcgcacactgtgcgcccctacggttatgcatgtgcagataatttacacggcggggcaccccagggtggcttctcttgcccttacgggcaattcaccttctgagggcaccccgccctacagtataatattgtattatggtatgttggttaaaccattggataaaatgtatcccgtagggtgcgacgacctcggcgcaccgtatcaaacggttggtacaatctgtattcggatacgtgcccatttaaccatatcgtgggcgaccaatgaccgcccctacgggataaccgttgcagatgaatttacatgcggtgcgccggggtcgtaccccagggcaccttctcttgcccttcgggcaattcaccttggcgcaccctacggtaaatattgtgcaagtgataaaatttgtaccacaaaatcaaatgcaaacgatatgcacccgataaacaaaaacggagaacggaaaacccttacggtaattctccattctccattttccattctcaatttttctcgatgtctcgaaacacgttcggcaaataaagctcatgcttcggaatcttctcccacgaaaacgcttccacaagctccttcgcggagaccggctctgcggtgtcggtcagtcctgcggcgcaggcaagtgcgccgatgacctgctcgggtgtgaatttctcccgcagaaggccgaggtcgaggtcctcatcgcgcttggacaggcggcgcccgtcatggtcgcacagcagcgggatatgaatgaagttcggcggtgtgaagccgaacaactcatacaaccagatctggcgcggcgtactgccgataagatcgtgcccgcgcacgacctcggtcacgccggacaggccgtcatccaccacgaccgccagctgatacgcgaacacgccgtccgaccgccggatgatgaagtcgccgcactcctcggtgagcgtttcggtatactcgccgtacacgccgtccgtgaacgtgatggtgcgctcgggcacgcgcacgcgcgttgcaggcgcacgctttctgcgcttttcggccacttgctcgggtgttaaatcgcggcaggttccggcgtagaccaccctgccgtccgacaggtgcggcgcgcttgcggcgtgcagggccgctctcgagcagaaacacggatacagcagacctttttcgcgcagaatcgcctcatatttctcgtaaacagccgtgcgctcggactgatacgggatttcgccgtcccagtctaaccctaaccaccgcaggtcgtcgataattaaatccgcgaagctgcgcggacagcgcatttcgtccaaatcctcaatccgcagcagaaattcgccgttctgctgccgcgcactcagccatgccagcagcgcgcacagcacgttgccgaggtgcatgcggccgctcggactgggtgcaaaacgtccgatggtgtgcatgtttttcactccttattgctttttcttcttggatttcggtgccggaagttcgtcatacatggcacgcagcagcttctgcaggagggcggcatcgtcggttttcgtcacccgcagcatgggttttgcgccgtcgtacggaaattcataaggcgcatccggaaggcagcttatcgcagctttgaccggcttgaccagcaggcggttatcataaattccgccgacgattttgccgttgtagtagagtatgtactcccccatcatggctcgatgcgttacgccgtccagtccggacaggcggtctaatatttccgcaagaaattcctttgtggttgccattatcgtcctcttttccagggtttaccgcttacataccctttttgataccagtattcatcgtcaatgggattcattttgcgctttttatggaacaggcggtacatataaaacaatcccttgaccttcgcgcacggcgtaacatttccggcatttttccgaatggcagaaaccgttttctctaccttttgctcgattttgtgcatgaaattctcgggcatgctgctccagtcgtatccccagacggcctgcgtgataacgtgcgtgcgaccgacgccccagtagttcatgctgtcgcgcaaatcccggacggtggatttcatgccgccgcccgccgcggtcgtgatgatgagcgcctgcttgcacatcagcgacaggtcgggccggtgtaccatccagcggaacgcaaagtggtcgagcagggtcttgacctgccccggaatgtggtaaacgtaggtcggcgcacagaaaacgatcagctcggaatcgtccatcgcggcgatgagcttctgcatgtattcatgcccgccgcacttgtcctcgcggccgttcatgcatgcatagcagcccgtgcagacatgcggcatgtcctgcggcagataaaattcgtgcagcgtgccgcccgaaagcaggcggtcgagcaccatctgtgcaatgccgtaggtggacgatttggtcttccgtttgtgcggatagagtatggttatgttcatagtgaacatcctttcttgtgtggaacaaatgacaggattagggatttccgttttgtgagcgaacactgttcgcccctgcggctgcacctgtgcagataattgacgaatgacacgctctccgctctcacgcatcctcctgccttcaaactcctgccttgtaatattaccacattcaccctatgctttacaactcccctgttctcttgtataatgtaggcaaacgaggtgacgcacatgaaaaaacgaatgcttgcgctgctgctgggtctgctctgcgccggactgacggcctgcggcagcacggacaccgccgcaaaggacgaaacgccgtccgcgccgtccgtcgaacagcccgagccggaacccacgccggaggaggtccgccggacggcggcggagcagtatgcggacggcttgacgctcgaggagcaggtcgcgcagatgttcttcgtgcgctgtccggagaccgacgcggcggcgctgacggcgcagtacgacatcggcggctatctgctgtttgcgcgcgattttgacggccagaccaaagaatccgtcgcaaataccatcgcagcctaccagaatgccgcaaaaacgcccatgctcatcggcgcggacgaggaaggcggcacggtcgtgcgcgtcagctccaacccgaatctgcatgacacgaaattccagtcaccgcaggcgctgtaccgcgagggcggctttgaccgcatcacgagcgacaccgccgagaaggacgcgctgctgcgcgatttaggtatcaatgttaattttgcgcccgtgtgcgacgtttcgaccgacccgagcgatttcatttacgcgcgcagcttcggcatggacgccgagcagaccggcgaatacgtccgcacggtggtcacgcagatggtcagcgacaaaaccggcatggtgctcaagcacttccccggctacggcaataacgcggacacgcacaccggcatcgccattgacgagcggccgatgaacaccttccggcagtcggatttcctgccgtttgaagcgggcattgagagcggggcgcagtcggttctcgtcagccataatgtggtaaactgcatggacgccgaccggccggcgtcgctctcagccgaggtgcaccgcattctccgcgaggaactcggctttgacggcgtaatcctgacagacgacctgatcatggacgccatccgcgattacaccggcggcgaaaacgcggcggtgcttgccgtacaggcgggcaatgatatgctcacctcgtcggatttcgtgacccagtacaacgccgtgcttgctgccgtacaggacggcacgattcccgagtcgcagattcacgcttccgccgtgcgcgtcatcgactggaaaatgcagcttggactgatttcctacgacgcgtaaacaacagagtcccggccttgtcgcttgacaaagccgggactctgcgctagaatcttaagtacaaacggcggcctgctggtaacgggcggtcgttccccatagttaagtgtttgaggaaacgccgctccggttacggggcggttatttctttatgtatcctaagataccaattttcaccgtttgcactttgatgatagcatgtgcgtcatattgtgtcaatcaaccgtcttttcaggcggtttttatttttgctgtaagagacggactcatgtatccgtcttttttctgtcataaaatgcaaaaaaccgcccaaaaaggcggcttattgacagattccgattgtatatgctataatcgaaacggacaagttcacatagcggtcagaccctctgttcctttcccgctgtctgcggcaggaaggaggtggcgcgaatgcggaaaaaggcatttcagcttttcgtatgtgcagtaatcctgctgtacatcttctgtataaaagcgcgatgaccgctcgtctgaaccccgaacggtcatcataatctaattatggtgcgagggtctgactgctgaacagtgtcctcttgggtatattatacccgagcagccccggctttgtcaagcgacaaggccggggttttgctatgcagacgaagtgaattctcaattcatctcaatcgcagatattctttccgatatccgcggtggcgtaggcattctgcagggttttgccgcgggtgcccgcctgatactcataatacgcctgactgccgatcatggcggcgttatcgccgcacagctgcagcggcggcataaacagctgaacgtgctcgcgctttgccatgtcctgcagggccgcgcggagaaacgaattggccgcaacgccgcccgcacacacaacgcgccgcgcatgcgtctgcttgacggccatctcgagccgcggcacgagcgtatgcacgacagctgcgcagaacgaggccgcgagaccgttccggtcgatggtttcgcccttctgctcggcgttgtgcgccagattgatgaccgccgttttgagtcccgagaaggagaaatccagcggcgcatccttgatatgcgaatccggcagcttgtacatcttcgcatcgccgtcctgcgccagcttgtcgatcttcgggccgcccggatagccgacaccgagcacgcgggcgactttatcgaacgcctcgcctgctgcgtcgtcgcgtgtgccgccgaggatttcaaactcggtgtagcttttcaccatcacgatctcactgtgaccgccggacgcgatcagtgtcaaaaacggcggtttcagctccggatacgccagataagtagccgcaatgtgtccccggatgtggtgcaccggaatgaacggcttgttcatcgcaaaggcgagcgacttgccgaagttcgcgccgacgagcagcgcaccgatcagtccgggcgcacaggtcgcggcaaccgcgtccacatcgtgcttgtccatttccgcgtccttgagcgcctgctcggtcacgcgcacgaccgcctccatgtgccgccgagacgcgatttccggcacaacgccgccgtacagcgcgtgcgtggcgatctgcgtgtccaccacgctcgataggatttttcgtccgtcctcgatgacggctgccgccgtttcatcgcacgaggactcgattgcaagtattttcatggttaatctcctaaatttttctcaaagcacaggcagttttccgcgcccgccggactgccgtagtacggaatgacgcgatagccgagcttggtgtacagcgccgccgaatcctcggtcgtgcgggcggtctcgaggatggccttggtgaagccgtgctttgccgcatcctgctcgagagccgcaatgaccgcgctcgcaacgccctttcggcggaactccggcgcgatgtaaatgcgcttgacctcgaatgtcccctcgtcgatcttcttccacgcgccgcagcctgcgggcttgccgtcctcgtacgcgacgatgcggcagttaaacagatgcggcaggttgtacttggcgtagcgcttctccacctcaccgacgagcatgaaataatactcgtccagtgcagcggtcaggtcgtgaaaatccctgttttccgcgtcaacaaagcgaagctccagcatggcaaaatcctccttcaaatcagtgaaatcgtcattaaaaccgcgttttctgtgggattgctgtaaaaattcttccgttttccgaccggcgcaaatccggctccggtgtagagcgctatcgccggtgcattgctctcgcgcacctcgagcgtcacaaacgccagcttgttttctccggctttcgctgtcagctcggcaatcagcgcccgcgcgatgccctgccgccggaagtcgggcgacacggcaacattggtaatatacccctcgtcgagcacggtctggcagccgacgtaacccgccgttctgccgtcctgctccgccacgagaaaaatgcccttgcccagctcctcgcgcagcatgttctcgctccacggcgcgtgaaagcacgcgcgctcgatctccgccagcgccgcgagatggcgctcctgcatcacgacaatgttcatcggctcaggttcttgatgaccgcctgcacgcccttgtcgatctcggcggcagaccggcggtaggtggcgagatcgccgccgaacgggtcggaaatgtcctcgggcagcagcgtgaaaatcttgtccgcgcagtctgggaacagctcgcacaggcggtcgtagtgcgagccggtcatgcagaccagatacttcgcgttttcggccatctcggcggtcagctgccgcgagcggtgcgccgaaatatccgcgccgcgttctccggctgcggcaaccgcgttcgcggaagccggaagaccgttttcggtgtataatccggcagaagccgccgttaaaccggtcttttcctcgccgttatgtgcgcggaataagccttccgccatcggggaacggcaggtgttgccggtgcatataaatataatctgttccattgtatttcactctcaactttataattgaaaattgagaatggagaattgagaatgtcgctatccttgcgcgagttccatccgcgctgcgacgaagtatcgcgcatagcgcgacttatttaataacggtgcttcgcaccgcacatcaattttccattttccattctccattttccattcagctcttatttcgcatcgtaccagctgtgccccgccttggcctctgccaccagcggagcatccatccgaaatgcgttctccatctcctcggtgagcagacgcatggcggtttcctgctcgtccttcggtgcctcgaggataagttcgtcgtgcacctggagaatcaatcggctctgcagaccgtctctcagcaggcggtcgcggacgcgtaccattgcaattttgataatgtcggcggcggtgccctgaatcggggtattcatcgcaacacgctcaccgaacgagcgcatattgaagttcttgctcttcagctcgggcagcgcgcggcggcggccgaacagggtcgtaacgtagccctgctccctgccggtctgcttgatgtcctccatatattttttaacgcccggataggtgtcgaggtaggttttgataaactcgcccgcctctttgcgcgttacgccgatatcctgcgcgagcgagaaatccgagatgccgtacacgatgccgaagttgaccgccttgcacgaggagcgcatctgcggcgtgacctcctcaagcggcacatggtagaccttggcagccgtcgcggcgtgaatatcctgcccgtgcttgaaggcttcgatcatgtgctcatcctgcgagatatgcgcgagcacgcgcagctcaatctgcgaataatccgcgtcaatcaggacgtgattttcgtccggtgcgacaaacatgcggcgcagttcgcggccaagctcggtgcggaccggaatattctgcaggttcgggtcggtcgaggacaggcgtccggtggcggtcacggtctgctgaaaatgcgtgtgaatgcgtccgtccaccgggctgatgaccttgagaagtccctcaacgtaggtgcttttcagcttggtcagcttgcggtactcgaggatgcgcggcacgatcgggtggtcctccgcgatacgctcaagcacctcaacgttggtggaatagcctgtttttgtctttttcggggcgtgcaggccgagtttctcaaacagcacctcgcccagctgcttgggactgttgatgttgaactcgccgtccgcgtcatgataaatctgctcggtcaggtcgcggatacgcacgtccagcttgtcaccgaaggcacgcagctcatccggctcgaccgcacagcccgccgcttccatctcagccagcacgcgcaggagcggcagctcgatttcgtagtacagctttcgcatgccgagctgctcgatccggtcagccgcctcggcgtagatggcgcgcagcgcaccggcatgctgcgccacggccttctcggtgtcctcctgaccgccgagcagcgaaaccgccgccggatcgtccagatccagctccggcagctcggcattgcagtacgcgagcgcaagccgcggcaggtcgtagccggactgggtcgggtcgagcagataggccgcgatggcggtgtcaaacacgatgcccttcgggtccatgccgcgctgcagcaacgcccgcacggcggccttcgcatcgtgcagcacgagggacagcgtgccgtcgaacagacggcgcagaatgtcgttccacgcgtcaccgaacgcctccgcgaacaggatatgcgcggtgtcaccatccagcaggcaaactgcacctaaggtttccggcacgatggcgtacacgcggtcgcagtcggtcagcgaatccattaagttgaacgcttcgagcacattctgggctcgttctgttttcagctccggcagacgcggcgcggacacgctctcgcccgaaaggtcaaaccgcttgatgaaattcttgaactccagccgggtcagcaggtcgtagagcgcggtctcgtcgatgtcctgcgcgggcaggtgctccacatccagctcgagcggcacattgcggtcgatggtggcaagccagaagctgtccttcgcggactgttcgccgttctgcagcttggtgcgcgcaccctttttaatgcgctcgtcgtcgatgttcgcgtacacgccctcgagcgtgccgaagtcgtgcagcagctgcatggcggtcttttcaccgatgccgggcacgcccgggatgttgtccgacgaatcgcccatgagcgccttgaggtcgatgagatggatggggtcgaagccgtatttctcgcggaaagcggcggtgtcgtaggtctgataggtggtctggcccatgcgggtggagaccagcataacggtcgtgccgccgccgaccagctgcaggctgtccctgtcaccggttacgaccacgcaggtgtcgccgtgctcgtccgcgcggcggctgatggtgccgagcaggtcatccgcctcgtagcccgccttttcgcaccggacgatgcccagcgcatcgagcacctgctttgtaatcggcagctgtgccgccagctcatccggcatgcccttgcgggtggccttgtaggtgtcgaatttgaggtgacggaaggttttctccttcacgtcaaagcagacgatggtgcggtcgggctgctcctcgtcctgcagtttgaacagcgtagccagaaagccgtaaaccgcgttggtgggcagtccctcgtggttggtcagctgccggatgccgtagaacgcgcggttcaatatgctgttgccgtctatcaccatgattttcatgtgtattttcctcgctcattgatacattatatatagtataccacattttcgtttatcctgccactgcttcaagcgccatccgcatcgcgccgatgagcgccagatgggcgggatagtaaatatagaaaaagtgcttcatcttccatttaccgcgctcattgccgagcagcaaaatcgggaagatcgccagcacgcagaagcgctgcaagccgcccatcacaccggcaagcgccagcagaccgaccgcaaagccgagccgctcgccgatgaccggcggaatgccgacaaacacgtgctcccagaggatacgtcccgctgcggcgtagaccggcaggagcacgcccgcgaagccgtagtcgatgtagaccgtccggcacagcaggtaaaatgcggcagcaagcgcggctgtgagcacgagaaagcgcagttttccgctgcttttccacgcctcgactccgtacagcagcaaaatggacaggctcagcgtgatgagcgcgttgccgtagaagccgccgaacggcagaaacgcaataacgcacactgcgccgcacgcgaacacgctgccgaagtagcgggctttgttccgcgtataacggcagccctctgcaatgcagtaggagaacagcggaaacgccaaccgtccgatcacgcgcagccacaccgcctgcggaaaaaatgccgcgccgatgtggtcaatcgtcatgcacaccatggcgagaatcttcagttggttcttggtcagcaatcacaccggcctcccctgtttgaatcttatttcattataacacgcctgcccgccaaggcaaagaaaaaaccattgccgcagggcacagcataccgttccgcagacataaaaaaccgccccgcaaagcgggacggttttcgagaggtgttatttcttcttttgcggaggcgtgctatgatgacagctgccgccgcagtgggcgcagtcgccgctgcagccgacggacttcttgacgaagaccgaacggaccgcgaagaacacgatagccactacgatcaatgccagaatgatatcaccaatactcatggttaaagcctcttttcaaatccgaaagaaatcagttggcgtcaacgctcatacggcgcaggccgtcggtggagtcagccttggccggcttgcggaacagcaggaagatgatcagcgcgatgaacgcgatggcaacgaccgtgccgacaccgaagctcagctcgccggtgatcagaccgccgatctgataaatgatggtggatacaacgtaagcgtaagcacacatgtagccgattgcgaaagcagtccacttgccgttgttcatctcacgcttgatggcgcccattgccgcgaagcacggtgcgcacagcaggttgaacgccatgaaggcatacgcgccgacctgcgtgaagtcagcagccagctcgccccagatctcggagccgtcctcggcaacctcgccgacgaagtgatacagctgaccgaaggtagcaacaacgttctcctttgcaaccagaccggagatggcggcaacagtggatttccatgtgccgaagcccggcagcgtgaagatcggagcgataacagagccgatacgcgccatgatggagttgtcaatatcggataccgcgcagaatgcgccgccttcccagccgtagccgagggtgaaccacatgaagatagtggacagcaggataacggtgcctgccttcttgatgaaggaggagccgcgctcccacatggagcggaatacgttgccggcggtcggaacgtgatagctcggcagctccatgacgaacggagccgggtcgccggtgaagatcttgaacttcttgagcatgatgcccgagatgatgatggacagcacgcccagaacgtaagcggagaatgcgatggtgccggagccgccaaagaacgcgcccgcgaacatcgcgatgatcggcagcttagcgccgcacggtacgaagcaggtggtcatgatggtcatgcggcggtcgcgctcctgctcgatggtacgggaagccatgacagccggtacgccgcagccggagccgatcagcatcgggataaaggacttgcccgaaagaccaaacttgcggaagatacggtccatgatgaacgcaacacgcgccatgtaaccgcagtcctcgaggatagcgaggaagaagaacagaatgagcatctgcggaacgaagcccagcaccgcgccgacaccggcaacgataccgtccattaccaggctgtaaacccagccgtcctcgttaacgcccatggaggcgaacagcttctccagcagcaccgggatacccggaacccaaacaccgaagtcagccgggtccggctcctcagcggtcatggtttcctcgaaggttgcgaggtcaacgtcctcggtggtgacttcaccggagtcctcgtcctcaaacgcggcagtgccgacaaccgatgcggcagccgggtctgcctcgatggcagcagctgcgtcagcgatagcggtttcgtccgcctcttcggcctcgagtgcctcagtcagagcagaggtgtcgatgccggcctcgtcggcagcctcgagccatgcgtcgcggcgggtgatctggtcgtcgtactcggcggttgcttcctcatagtcggcagcgccgatggtgaacagatgccagccgtcaccgaacacaccgtcgttcgcccagtcggtgaagatgccgcccgcggtggatacggaaacgtagtagaccagccacatgatcagtgcgaagatcggcagagcgaggattcggttggtaacgatgtggtcgatcttatccgaggtggacagaccggtctttttcttctttacgcagtccttgaccagctttccgatgtactgatagcgcgcatcggtgatgatggactccgcatcgtcgtccagctcctcctcaacggcggtgatgagcttctcgatcttgtcctgtacgtccttgccgagcgtgaagcgcgcctgcaccttgctgtcgcgctcgaacagcttgacagcgaaccagcggcgctgcgccggctcggtaacatccgcgatcagcttctcaatctcggtgacggcgttctcgatggtaccctcgaacgcacgctttgcgggtgcattgcctgcctttgccgccttcttggcagcctcgaccagctccttggtgccctcgcccttgatggctgcggtctcaacgaccggcacgccaagctcctgagacagcttctttacgtcgatcacgtcgccgcgcttcttgacgatatccatcatgttcagcgcaataacgaccggaatgcccatctcgagcagctgggtggtcaggtacaggttgcgctcgatgttggaagcgtccaccaggttcatgatggcctgcggcttctcgtttacgaggtaatcacgtgcaacgacctcctccagcgtgtacggagagagggagtagatacccggcaggtcggtgatcaggacttccttgtcgcccttgaacttgccttccttcttttccacggtaacgcccggccagttgccgacatactgggtcgcaccggtcagatcgttaaacatcgtggtcttgccgcagttcgggttgccggcaagtgccaaacgaattgacatatttttcccctttcttaggattagtatctgctaacccttatgtaaaaaaaattttttgacgggttttgtgtgacatttcatccacctttgcagtcagaaccgtgcgccgatgcggtacaccggcgcagaattcttcttataaggggaatgagacagacagcagcacatcgtttataaaacagcgtgccggtgtcctttagtcaacctgaatcatctcagcgtctgccttgcgaagcgacagctcgtagccgcgcacggtgatctcgaccggatcgcccagcggcgctaccttgcggacatagatctccgcaccgcgggtgatacccatatccatgatgcggcggcgggttgcaccctcgccctcaatcttgcggacggttacggtggcgccgaccggcgtgtgtctcagattgctcatttgcgtttgccccctttgcaattaaaccataatgcgcgaagccatctgctcggagattgcgacgcgcgcatccttcacgtttacgatcacgttgcctgccagagaggacacaaccgttacctttgcaccctcgacaaagccgagattttgcagaaattttctcgtctggtcttttcctcgaatggactttaccgtggtttcaacccccgtatccatcaatgtaagcggcataatggtaaccctctccttttctgtaatctctgcgtgaaaaaagtgtttttgtatcgggttagaacactctaacccctttatcatttgaagtttacaccagctaaccttttgttgtcaagacagaaaaaaaagtttgtcgaagctaaccaatctgtacagagtttgccgtggctaattgtgcagtatgctgttgctaaccgtgggcatcctgcagataggaggaagcccgcggccattgttccggatgaccgcgggctcatgttgaggctgtcaaaaaactatcgtttttcgagcagcctctcgctcgaaaccacgctttcgagcgaataccgaagaaaaaccgcgccctgacgggcacattttttcttcccctgtataaattccgagatacgcgctcccggaatttatgaatttgctccgcaaattctattttatgcgtgctgccgcacgaagcgtaaaaattaaaataatacttttttgacagactgcatgttatcggggtaacgccgctgccgaccagccttttccgcagataggaggaagcccgcggccattgttccggatgaccgcgggctcatgttatgttttgacataccgggcagtatgccatggggtttcccccgggacaagaaaggatatttgtatcataactcgtgccgtcgcacaagttacgaccgtgagaaattatttcggcgctgcgcgcaggtatgcacacgccgcaagagaaaatctaatttagaatgctgcgaagcccttgccgaactccttgcactttgcgatgccgtcgtcgtccggggtttcgttgatgatgaggccctcatcggtgtagatgacagcgtttgcgtcgttggtacgctgtacccagtcgcgcatccactggccgtcgccccagccgtaggagccgaacagtgcaaccttcaggccggaaatcttgctctccagctcggtgaagaacgggtcgaactcggtctcctcgagaacctcggcacccatagccgggcagccgagcgcgatctttgcgtacttaacagcgtcagccggggtggtgtccgcaacgttcagtacgtcaacctccatgccgccctcgcggatgccgtctgcgattgcgtttgccatctgctcggtgttgccggtctggctccagaaaataactgctgctttgctcatgatgattttgctccttcgcatgtattgttctatatttgtagttctatcgagttatgctatgctgcaaacacttcgagaagggtttcgcccttatcaacgcgtctggtcacggcgtggcatacccgcgataggcggtcaaacagccgggatgccgcttcggcatcgccgtacaccttccagagaccgcttaatttgcagccctttccggcgtatcgaataaagcccacaacgtcctcgatcgggtatccgaggaacagtccgatctcgtgcggaaagtccttggacatggcgatgcggcgcttgagattgcgcagcagtacgtcgagcggctgaccgaccgggtacgcaaagtgccggagcacatgctgcacctgcgggtccgccatgcggcgttcaagctgcggcttgctgtataccagtaagaggaagcgtgcgctgcaggcgcagacgatctcgaagtgaatttctcgcgctgagaacgcatcgcggtattcctttaatcgctgcggcagatcgggatataaattccggtcgcacgacaccagacttgccggtttgatgcccgccagtgtcggcgagcagtaagtcgctaaaagtcgatccaagccattttgcattgctgatgcacctcccgtttacagtatttccggtctgtacatttggtatgcgtttttcccgaacagcgcggctgcggttagccattcagccgcgcaataccttaacggttttgttcggaatgatgcgcaaaatacagaggaagctgtttcttttataactattcagcacgttcccgttccgtgaggaagcgtgccggtcaacggggcgtatcagtaagcctcggctaaccatgtatataagttagcatatcctaaccaatatgtcaagcactttttcgagagaaattttcggctgaatcccgggcggttaggttttgctaactatgccgttcggatagacgtttctcagcgtgagaatgggcgtttttgctgccttttcgggcgggaaaattttttcgggatttcccggattttctgcaccgacccaacggggtgcgcgaactgcgtcagcgtgttcgcccctaacgggcggctccttttctgcaccggaaagccggggtgcgcgaactgcgttagcgtgttcgccctttccgggcggagagtttttcgctgaacctcagcggggggattcgccgtctgcggacggcgggagcatcgcggcgcccgccgcaggggcaaaaaggaaggacaacctgcggttttccttcctctttgaactcctacctttcccttgctttctaatccggcgcagattgcctatatgtgaccgcttcgaaaatagggaacggcagaggattttttcttccgtgtctttcgcaacctattcgcaggggcagatactgcactgctacacatgtgggttagtttacgtaggcgcggcatgacagtgccgcacgattctttagcgcgttattatagacagggcctgcgaagataaatagtatcaaacgcctaaatccgcaggtgccgtccggtacaatgcgttaaagagttgcgcggcactgctatgccgcgccctgcgtagagtaaaccatatgtgtagcagaacggtatctgacactgcgaatatgtctcgacatgggagcacactgtgctcccctacggtagaaaaactcctctgccgttccccttttcgcagcggtcacatgttggtaatctgcgccagactatccaagggaaaggggtgattcacaagagggtggaaaccgcaggtgtctaccctcttgtgcgcccgcgcggcgtcagcgcacgttcccgcgctccgcagagcgcaactccccgctgaatcccagcgaaaaactccccgcccgaaaagggtgaaccgcctgcgcggttcagtttccccgcccagccggtgctgaaaaaggaaaagggcatacctttcggtacaccctaatgtataaattattccacttccacgccattgatccgcgcggattcatccccggtgagcggaatgacaaggcacttctgcccttccatgacctcggtatggacgttcgcggctctctcctgcggcatgcgaacgtcgatgaccgtgccggtctcccacggaacgtcgtcctcgtccgcgtcggtgacgtttgccgcctgatgcgccagctcctgctgcagcactgccaccttctgctccagggcggcggtatgcgccttgaccgtgccctcctcgaccagacggctgtccagcacgttatgcgcctgcggcggctggtcaccgaacacctgctcgtacgacttctcgatctgcgcgcgcacgttgtccggcacctcggcctcggtcgccagaccggagaccgcctcggcggttagctcgaccggcggcaggctctcgtcctcctcccgctcggccaccatcgcgctgatggtcttctgcatctggaagaacgccgcgtccgcctgctcctcatcctcaccgaaggcgtcgtgcaccacgttcttgaacgccagcttgtcctcggcagccgtgcgctgcgcgacacagccgagcacgttctcgatgaactccggatgagagggacggccggtcttgacgtagtacatcacggcgttgacatcgctgccgcggtttgcaaacgccgggtacacaaagccgaggtcgggcagaccgacaacccagtcgcgctcccgcgcaccgatgcgattttcgtcctccctgtagccgagcgcaggcttcgccagctcgaccggacagaccgcgcacacgcagtacgcatacagctcggtggactcgtcctggtcctcgcccgaggtggccttgctcggcacgtcgtacacgtcgtggtaaaccacgatcaggtagttgcccgggtagctgtactcctcgatcacctgctcgtacaggcggtcgagcagctcctcgttcgccagcttgctgtccttgagcgtcagcaggtatttctggtgctcgatgccgctgtcgctgcggtcaaactccagttccagcaggtttgcgccgagcgtgccgctgaacgtctttttcgcgatctcgaggtacttgtagtattcatcctcttccagttcggaaaactgctcggtgaacttggtcacgatctgcttgccgctgttgacgtagcagccgcacagacgcccgaacgtgcattcggtctttttcaaacggcggcgcagctcctgcacatcgcccttggtgatattcataggtttcgctccttagcgtgtggattcggtatatacaagtatacggcattttccatgcaaaaggcaagcggtttcacataaaaagcgcgatgaccgttcggcggcaaccgtacggtcatctgtgaaaacttttgactgaacttgggagctgaccgtccagcggacggcgtttccctttaattacattaaaacacactttcaggcactgtcaacctgcggaaattgacaaatcccgtacattcgtgttatactttgacttggaaacgctgttgcatagatcagcggtcagcctcctcttttcctccctcggtccgaggcggaaaggaggtgcagcaaatgcggaagaaggcacttcagctttttgtatgtgcgatcattgtattgtacattttctccgtatatgcgcgatgaccgcttggctggtacccaaacggtcatctcaaatttcgtagatgaatcgggggttgaccgctgtgtaaacggcgtttccctcgttgtacttttattatatcacactttttagccttgtcaacctgcggaaattgacatttttcgcacgtcctgttatacttaactcgtggaaacgctgttgcactcgcagtgagcaatcactgcaggcggtcagaccctcttcttccccacggtctgtgggcggaaggaggtgctgcgcatgaggaagaaagcctttgagctttttatctgtgcggtcattgtactgtacatttttctcgtaaatgcgcgatgaccgcttgggtagcctccaaacggtcatcgtcttaaaacatggtgattagttgtaaggtttgaccgctgtgcacggcgtttcccttttgtatctttattataccacacgagcgcatgttgtcaagcggcgtgatttgccgtaaatgcgcgatgaccgctcggctgactcccgaacggtcatcttaacaaatgacttagcgaaggtctgaccgctgtacaacagcgtttcccttttgtatctttattataccacactcccgcgccaagtcaagcgcgggagcatttttatgcctgctctgcgctttcactctgccgactctctcccggagcgttccccggtttctgcggcggctgcaccctcacctcaggcgggtttctctcatcgccggactgccggaaccgatcgtcgatatgctcgcggagccgttcggcgtggccgctgctgcgcgaggtcacggtgatgctgacgctctcgccttcctttgcttcctgccggacggtatgctccaccgccttatcaatgtgtacaaaccgcggaattttgccgtccggcggctgctccctgccggaaacgcgggtgccgagcacctgatcgaaccggtttaccgtatactccacgctgtccgtgccgcccacgacgctgacgctggcatacggctcatacgcggcgtacacgccggtggtcgccatgccgcacaggacagccacgcacgccgcccaggtcagcggctttttccaccgtctgcggcgcttcgccggaatccgaatctcctgtccgaccgctctgttctttgcgtctacaagatgaaccgtgccgtcctccgcgagcgcggcggcctttcccgctcgaatatccgtaattatcgcacgcattgctctgcctccttgcgcatggtctgcagataggtgcagaggatggggtaatcgccgtcgatgagcagcgccgccgctacaatgtaatcccggtgacgggttatcgtccgcgcggacacgccgcactgttgcgcgagcgccttgatgggcaggctgtgcgcgctctgcatggacgcgaacagcaccggcgaatgcagcagcgtgccgaccgccgcgacgcagctgcggcgcgtcttgtccgacttgggcgagcttgccgctaaatcataaaacgcgaacccatacttctcaaacaccgtgtttgccgcctcgatctcatcctgtgcgctgaccggctttgcctcgctcatctgctccgcgaccgcctgctgcatggcggcgtccgcgctctcgcggtccaccgtgccgtcgaacgtctgcggggcaagcggtgtttccgcgtcaaaccggtgctgactgcggtaatggtcggcaaggcgtctgccaatcacaagcgacgcatacgcgccgaacggcccgcttgccgggtcgtaacccttgatggcttcgtagaaggccagcagcgcgaccgaatattcatcgtcgctgcgcgtgaccgcaaagcctgcatgcctgctcgcgcaccggagaacgaatgcctcgtgcgcctcaatgaaccgctccaaaaacggctcgtccgtgcgtgcgcggactgcctgtgtgctcgtctgcatgccgccgcctcccttcctttgatgatactatcataattttgctctgtgttgaaacggtgtaccgactgttaccgttctgcgtagacttccgtatgttttgaaggacacagacagcaaaaagcaccgcagcctgcattctgcggtgctgaggctgtcgcgaaactacagtttcgccgacaagcaggaacggaccgtgggccgttccaaagtcgtccgaaagttcctatacagaaactttctccctccagaagtgaaaaaaccgagatacatgctcccggttttttcggattgcagagcaatcctaatttaatacgcgctatcgcgcgaatgggctgagtccatacaaatatcaactttttacaaaataaagcaccgcagcctgtattctgcggtgctctttcttttacttggtgagagaagcgaaacgctgcagcattgccgcgcactccgcgcgggttgccgttgccttgggagcgagtgtcgaggacgttttaccggtcaggataccgttcttgacgcaccactgcaccgccttttccgcatacgcggaaaccgagcctgcgtccgtgtaggcggacaggtccgccgcgccgtccggctcaccggcatagcggtacagcatggcggcaagctgctcacgggtgatatttcggttcggagcagagccatcggatatgcccttgttcttcgcccagttcatgcccttttcataccaaaccgtgccgccctctgtcgattcaccggcataacgcgccaatacggtcatcagcattccgcggctcatggtcgcgctcggtgaaaaggcggtcgtgctcgtgccgttcatcaggctgttgctcgtgacgtactgcaccgcacttgcaaaccagctgttctgcggcacatccttgaagctgccgaccgtggcctgactgccgttctggttcggctgaccgccctgacccggcttaaacgtgctcatcgagctgcttgaatcagtggtacccagctttgcctctgccgtgccgaccgaggtaccgtccaccagaaccatgtacgtctcgccctccttgatatccgccgaggagaagatcacactgctcatcgagccgagcgcggtcgcggtgtaaagggtcttgccggaggaatcctgcacggtgataacgctgccctccttgatgccgagggcgctctcgcggttcggcagattgccggacggcttgccgtccgccttgccgccggagggcttggtcggcggcgtaaacgtgccgtcggtcgaggtattgccggagaaattcggcggggtcggacgattgccgtcagccgagccgtttgcgtcacccggcggggtcatgccctgaccgccgccctgtccgttcgggccgccgcccataccgccgccggacggcgaggtctcaccaaccgcgatatacgcctgcgtgccggcgctcggctccatgcccgcgccgaacaacgtgccgccggacagcgtgaacgtgccgtcatagtcaatcgccgcgtccatcatggcatccgcgccgtacacctccaccttgccgccggtcatgctgatatcgttgttggagtccagaccgtccgagcctgcgtcaatgtacaggtcgccgcccgcgatgttgatggcgtacttgtcactgcgctcaccgagcgtgctgttggcggcatttacgccgtcgtccgaggcaaccacgtcgatatcgccgctgtacacggtaacggtcgtgccctccagaccctcatagcttgcggtgatgttgatgcgcggcgtactcgtcgaggacgcacccctggcgccgatcacaaggtcgttgtccgcgtgaacgccgtcgtcgccggtcgcaagggtcagcgtgccgcccgaaatcgtgacatcggtgcccgcgtgcagcgcatcgtccgcgctgtccacggtcagcgtgccgccggtgacggtcagtgcgccgcccgccttaaagcccttgcaggaggcggaatcgtctgtgagcgcggtcgtgtggccgccgttcgtcttgacatgaaacgtgccgcccgaaatggtcaaatcgccgtccgcctgaatgccgtcctcggtcgcgttgagcgtcagcgtgccgcccgagatggtcacattgccgagcgaggtcgtgtccgggttctcggtgtcgcctgtgtccggagacgccttgaccgcatcgccgcccgccgtgatgtgcagcgtgccgccggtaatattcagctcatcgtcgcaggacagaccgtcgttcgcggcgttgatgttcagcttgacctccgcaaccgtaatcaccgcgtcagccgcacccttgatgccgtttttcgcgttgccgtcaacggtcagcgtgcccgtgccgccgatggcgagcgcggcgccgctcttgaccttgaccgccgcgttctcgtcgctcgagccttcggtgtcggcaaccgtgttggtcgtgcccgccgccgcaatcagggacgcctcggcggtcttgttcagggtgatcgccgcgctgtcgtcattggtgagcgtcagaccgttcagcacaatggtaacgcccgtgacgccctttttgaccgtaatcgagccgttatcgcagtcgccggagaacacataggtgcccgccgccgtgatagaaacgtcggtgccgtcaatctcatagccggtgtacttgccctttgcggtcgcggacgagtcggttaaggtgacgagcgtcgcgttcgcggtcgtgtagtccgaagccgcacacgccgatgtcagcagcatccccgccgcaagcgcggaagccagcaaagcggcgagaagtttctttttcataatattcaatcctttcacaggtctaaattcagcttaaaggtctaccgtagggtgcgacgactcggcgcaccgcatcaaacgaataccactgtgttaaatggtattggcaaccgttaccgataacgtattccgttgttttgaaatttgcgttgcggtttacacggcgcgccgagtcgtcgcgccctacggtcaacatggtcattatcgttacaaagcttccttcacctgcggcaccttgccgcaaacgatatcgaggttgccgttccggcaccggatagcgtccaaaaactgcttctcaatctcgggagaaaccagtcttacatggtaatgcagattatacaggctgcccatgccggtggtacgcacggaaatcagctctgccgagcgggtatactccccaaacagatcgtcaaacaggccggtgtagtcgaggttctccggaatggtgattttcagctccttctcctcctccggctttctgccgaaggacagcgccgcgtaggcggtcagcaggatgcacatcaccgcgccggtgacaatggcaatgccgatgtagcccatgccggtggcaaggccgagcgtcatggcgaggaaaatgcaggtaatgtcacgcgcagagccggccgcggagcggaatcgcacaaggctgaacgcgccggagacagccacgcctgcgccgaggttgccgttcacgagcagaatgatgacctgcaccattgcgggcagcagcgccagcgtgaccgccatggactgcgtgtaggtgtttttgtacatataaacggcggcaacgagtgcgccgagcgcaagcgccaccagcaaacagataacgaacgcgctgccggtcaggccggcggtcagaatcgaaccgaaaattgtctcaagcacagtaaatttctcctttttcgttgatgtgaatggtttcgctgccgaactgcggcgaacggtcctcgcgcagcatggtctggtacgccgcgccgtatttggaaaagtgggtcgggaaaatagcgttctcgctcagcacccgcgccagccacaggggcgttgtgccggggatctttatctccatcaggcaggtgtcgtgcggcagcagctgcgcgcctgccgagccgcaggacaagtctaaatcgtccatgcgccaccgaatgcccgagtcgaacgtcacgcgcagctccggctgatacttgtcaaacagcgcaagccggtcgtagcagatgcacatggcaggctgaatgcccttgtagaagtgcagaaaccagtcgatctcgcgggaaatctggctctgctcgggtgccgcgccgctgtctaaatacgcctgcgcttcgctgtaggtcatcgcaacgcggcgcttgtagacgatgtggtcgtattttttcttgatctccacaaacgcctcggtatcggcacccggcgtgcggtaggtacgcaggcgcagcttctccttgtacgccggacggtcgagcgagcggcggatgagccggaaatccggcgtgtcgtaatagatgttgctgatggtcgattccgcgaaccggtcgggcaccatccgcgccgcaaacaccttggcaagtgcgttgtactgctgctgcgtgaccagatatttcttctcatatcgcttgaatgtgccttgatattcactcatggcgaacgcctccttcggattgggtgaaagccctttcatttttgcttctgtctgtaaatgcgaaggcgttcagcggattttcggcagtatcacaaaaggtgcacccgctttacacaaactttacacaagggagcgccgtacccacggcggggggatgacgccgtacccacggcgggggggattcgccgtacccacggcgagggggcaaaaaggaaggacaacctgcggttttccttcctctttggactcctacctttcccttagatagtctggcgcagattgccgacatgtgaccgctgcgaaataggggaacggcagtcgggttaccgcagcgtgtctttcgtgaaatatttgcagttcacagacagcgtactgctacacatgtggttaaatcaacgcaggcgcaacatacccgtgttgcgcaattctttagcgcgttattatagacagggcctgcgaagataactgctacctaacacctaaatccgcaggtgccgtgcagtataacgtattaaagagttgcgcggcacggttatgccgcgcttgctggaagtagccggtctgtgtagcagaatggtatctgacactgcgaacaggttgctcaagaggacggactccgaaggtagttcgtccgtagcagagaaaaaatcctctgccgttccccttttcgcagcggtcacatgtcggcaatctgcgccagattaggaagcaagggaaaggtaggagttcaaagaggaagggaaaccgcaggtgtcccttcctttttgcccccgcggcgggtgccgcagtctcccgcgctccgcagagcgcaactccctcgctgaacctcagcgaaaaacctgccgcccggatagggtgaaccgcctgcgcggttcaagtcccccgctcagccggtgctgaaaaaggctgccgcccgtcaggggcgaacacgcctgcggcagttcgcgtcccccgctcagccggtgctgaaaaaaggctgccgccccgtcagggacgaatccctcccgctgtggttcagcgccgcaaaacaaaaacaccgcagacccccagtccgcggtgttctgttttattccatttcgtcaaggacggaaaaggcagcaagctgctcggtattgtcctcgttatactcaatctcgcgcgagtacgccttgcagatgcagatctgcgcccagtgcgtgacctcgcccttggcgagccactcgtacacatcgagcagctgaatgaccgccgtgctcacgagcgccagctgcaccttgtcctgcacggcgtcgtctccgagcgccttcataaagtgccggtacaggaagtacgtcagcaggttatcgtattcatggcgttttccctgatacgcctgcaaaaagtcattcctgcgggcgataatctccggcaggcgcgcctttgcgccggtcagcagcgtgcgccagtcgtccttgttgatctcaaagccgagcagcatctcgagcaaactcgtgagcgtgctctcccgccagaacgcctgcgaccacgaagccgtgtcctcgtccgtctcgtctgcatcctcgtcctcggggaacgggaacagcaggtcgtcgtactgctcctgctgcgcctttgccgtgcggtagagcctgtcggccttgtcatcgaacggcgcgtcctcgcacgccagccggaacagcgcatcgcgcatggaaaacagcacgttctccagttcggtttcggcctccgtgccggtttcggatacgccgtccgcctcggtcacgtcaaacgccggtgcgccggtctgcgcgagtatcaactcggcggcagcctcacagcacaagccgagaccgtcctcgcggccgtccgaaaaccactcgtaataccgcgggtggtcggtgcagatctgcgccattttgtcctcgcctaagtgaagcagcacctcgcacaggttgcagtcgttcagcagcggacaccgctcctcggcgtccagacgaaaatgcgccggctctccggtctgcgcgtccgcaggcgcaatgctcgcgcgcaaacgctcgccaaaatcgccgggaacggtctcgtagtacgcaagggaatcctcgtctacgtcgatctcccagccgatacagcagttttccgtgcagtccgagccgatgcaccggaatgccttgtaatacgcaggacggcgaatgtagcccatcctaatcacctctcttgtctgtctcattatagcagacacgggcgcggttgaaaagggttatgacggcaccgccttttcccttgtgtaccgcttgacccgctcgtaccattcccgatcgaacgcggacagctgttcgctcgacggcccgattgcaggctgcgccggtgcgggctttgcccgtttctgcatatcctcagcggtgagaatgccgtcacgctcgcagttctgcagcagcgtgcggaaataccctgccggattgcgcggtgcattctcagccgtctgtcgggcggtatctaagaacacctcacgttgcatacccttgttctgcagcctgcgcagctccagacagaaattatggtcaaacttacaattcagtttttcttccagttcggtcgtcagaccagaatcagccgtaactgctttctcttctctggtctgctctgctctactgtcctctgctcttctgttctctgctcttctctgctctgtggattttcggtacaataaatcgcattttccgtacgataaatcgcattttccgtgcgggaaataaatgcacgcagcacaaaagacttgccactcggattcttctcccgcatttcctgctcggtgagaagccaaatgtcaaaattgatgggaactgcattgcgcgtcacggtcgccagaaaataccccatctgtattcttttggatgtgagaaagccgcgttcatataacgcagcatggaacaggccgcttgccgccagctgatcgactacggcggccagtgtttcgatcgtcacgttttccagtccggcggtgtactcgcggagctgccacagcgtgtcctcgcggccctcgccgctgtaggcgatgtagtagcccttgtcgccgtaggcaatgtcgagcaggcattcgtacacatacggcccgagcacgccgaatttctgccgtgcggctctcagcttcgggtcacggtacaggccgatatcgcgcggccaccagtccaatccaacttttctgtttctgcccatgtgagcacctccctttaccctaccgccggaacggataaaaaattgaccacaaatggtcaactccgaaaaaaatattttccgggaaataaaaaaacatcccctgttcacagtcagaggatgttaaaatctgttcgcagcccgcgcgtaagcgcgtattcaataggattgctctgcaatccgaaaaaaccgggagcatgtatctcggttttttcacttccggagggagaaagtttctgcataggaactttcggacgactttggaacggcctacggtccgttcctccttgtcggcgaaactgtagtttcgcgacaggtaatgcaaaaagagctgaaaccttacaatttcagctctttatggcggagagttagggatttgaaccctagagacgctcatcacgcctacacgatttccaatcgtgcgccttcgaccactcagccaactctccatcttgttaagttgttgtcgtttttgatgactcatcgctgacgacttgtttagtatataacagaatccccgtttcgtcaacccttttttcaaaattttttgaaaaagttttttcaggtcgaatctgcaccattttcctgccgtggtttaccgttgctatccgatctgtacacgtcatcccgcaggggagcacattgtgctcctacgttatggttaaccggatgcgtggccgttccttgcacaggctccggtcgtgctgcgggcgaacaatgttcgcccctacgggataattatgtgcaggtggtaaacatacggtaaatcctttcaaccgccaaacgcaaaaaagaaaaccgcctgctctcacaaacggttctcccctatttacttctgaaactgctcgcgcacttccatatacttgatgatctcttcaaccgtgccgtcaaagccgagcacgccgctgttgagcgacagatcataattccgcgcatcataccagtcgtggccggtgtggtgcttgtagtagcgggcgcggtaatcgtcgatctccgcgatcttcttctcgacctcctgctccggcagcgagtccaccttcatggcctgctcgagacagaaatccttgtccgcatggacgaacacgcgcacaacatccggtcggcctgccagaatatagtcggcacagcggccgatcataacgcacggaccctgatccgccagccggcggatgatcttcacctgataggcgaacagcgcctcatccttgaggtaggacttggacgagtcgttcggcacgggcgcgttgccgtgataatgcgcgcgcaggcgcgtcaggaaatcgcccttgagacgctcgtccgagaacagcatggcgtttacaccgctgtcctcactcgccatggtgataatctcgcggttgtagaacggaatgcccagcttgtccgccagcatcttgccgaccgtcttgccgcccgagccgtactggcgcgcgattgtgataacgtaaggtttcataatttaccccctacataaattgataattgagaatggagaattgagaatggtggtatcgcgcatagcgcgattatttaatatcggcgctgtgcgccgcacattcattttccattttccattctccattttccatttccgaaatttattctcccagataagccttcttgatggcatcatcattcagcagatcagctgccttgccggtcttgacgattttgccggtttcgaggacgtagccgcggtccgcgatggacagcgccttctttgcgttctgctctaccagcaggacagtggtgcctgccttggacacttcctcgatgatcttgaagatttcgccgacgaacagcggcgacagacccatggacggctcatcgagcagcaggatgcgcggcttgctcatcagcgcacggcccattgcgagcatctgctgctcgccgccggacagcgtaccggctgcctgatttttacgctcctccagacgcggaaaacgctcgtagaccattttcagcgactccgggatctcattcttcgggcgggtatacgcgcccatacgcaggttctccgcgaccgtcagacccgcgaacacgcggcggccctccggaacgtggctcatgcccagctttacgatcgtgtgacccggcttgtgcgtaatgtccttgccctcgaacgtcaccgtgccgcccttcgacggcagcagacccgtgaccgtgtgcagcgtggtggtcttgcccgcgccgttcgcgccgatgagcgctacgacctcgccctcgtttaccttgaaggaaacatcacgcagtgcatgaatcaggccgtaatacacgttgatgtcctttacttccaacattgccatacttgtttcctcctttcttattcgcccagatatgccttaacgacttccggattgctcagcacttccttgggcgtgccctcagccagcagacggccgaagttgagcacatacaggtactcgcagatgccggagaccagcttcatgtcatgctcgatgagcaggacggttacgccgaacctcttgcggacgatttcgatcgtctccatcagctcctcggtctcgttcgggttcatgcccgcggcaggctcgtcgagcagcagcagcttggggttggtagcgagcgcacgcgcgatctcgagcttgcgctgcttgccgtacggcaggtttgccgccttgtagtcggctacgccgtccagatcgaacacgcgcagcagctccatcgccttttcatccatctgcttctcctttttgcggtaggagccgaggtggaacatgctctctgcgaacgagtaggtgatctggttgtgcagaccggtctttacgttatccagcacgctcagctgcgagaacaggcggatgttctggaacgtacgggcaacgcccagtttacagatttcatgcggctttttgccgatgaggttctgtccgtccagacggatgccgccgtcggtcgggcggtacacgccggtcagcatattgaacgcggtggtcttgcctgcgccgttcgggccgatgagaccgaccagaccgcccttttcgattttcatgctcagctcgtcaacggcacgcagaccgccgaacgaaatgccgagcgaagtaacttccagcattgccatggcttacgcaccctccttcttgccgccggccttttcggccttttccatctgacgcattgcgcgcttctccagcaggcgaaccttgaaggaggagttgttgaacagcatcattgcaatcagcaggattgcgtagatgagcatacggtagttgctcaggccgcgcaacagctcgggcagcagcgtcagcagcgctgcggcgatgatagaaccccagatgttgcccaggccgccgagaacgacgaatacgagcacaaggatggaggtgttgaagtcaaactttgccgccgtaacggtggagaaattcatcgcgtacagcgtgcccgccatgcctgcgaacgccgcagaaaccacgaacgcgagcagcttgtagtgcgaggtggagatgccgatggagtcagcggcgatcttgttgtcgcggaccgccataacagcacgtcccgtgcggctgtttacaaaattcagcacgaagaacagcgtaacgaggatgagcacaacgcccgaggtgaaggtggagatcttggtgacgccggatacgccgatcgggccgttgatgatcatcttgccgccgtcgcccagctggaaattctggttgaccagactgaaatgcagaccggcatcatccagaccgagatacataacgtttacaaggtttttgatgatctcaccgaaggcgagggttacgatggcgaggtagtcgcccttgaggcgcagtaccggcacgccgacgatgacacccgcaatcgccgcaaacagtccggcaacgaccatagcgacagccagacgcagcggtgcaagcggaatcgcatccgccagacaggtggtggtgacaatgcccgcaaacgcgccgaccgacataaagcccgcatggccgagcgacagctcaccgaggatgccgacagtcaggttaagcgagatcgccatgacaacatacgcgcagatcggcacgagcagacccttgatctggctggagatgccgccgcccgcgatggctgcctgcacgatgatgtacgcaataatgacaatgccgaagcacagcagcgtgtcacgtccgcgcttggacgcagcataggattttaacttgttcatatgactgcccccttaaaccttttcgctcacatgcttgccgagcaggccgtccggcttgaccagcagcaccacgatgagcactgcgaacacgatcgcgtccgacagctgcgtggaaatgtacgccttggcgaaaatctcgatgatgccgagcagaatgccgccgatgaacgcgcccggaatcgagccgatgccgccgaatacggcagcggtgaatgccttgatgcccggcagagagccggtggtcggcatcagggtcgggtacgcggagcacagcagcacgcccgcgatagcggcaagacccgagccgatggcaaaggtgatggaaatggtcgtgttgacgttgatgcccatcagctgggccgcgcccttgtcctcggaaaccgcacgcatcgccgtgccgaccttgctcttgccggtgaacagcatcagagcgaccatgatgacaacgcaggctgcaatggcaacgagcgtcaccttggagatctgcatctgaccgccgaacaggctgagtgcctcgccggtaacgaccgaggtaaaggtcttcgggttggaggaccagatcagcagcgccgcattctgcaggaagtacgaaacgccgatggccgtgatcagcaccgccagcgacggcgccatgcgcagcggcttgtaggcaagtctctcaataacaacaccgagcgcggtgcagacaataacagccagcacaacgcccatccacgccggccagccgagataggtggtagcgcagaagcacatgtagccgcctaccatgataacatcgccgtgcgcgaagttcagcatttttgcaatgccgtaaaccatcgtgtagccgagtgcgatgatggcgtagatgctgcccagactgatgccgctgatcaaatgattcaaaaagctcatggtttggaacacctcaaatctttgtttctcctgtttatgaaatggggcagtggttcggcaatggtcaagccaccgccccaccccataacttttggtggatgataccttctccgcagggcagcccgccctgcggtacaggtatacctctttataaatagcggtaaaggaggactgcttccagacctccttcactcgcccttgcgttcttaatatgtcccgggcgagctttgcccgtccgggacaccgctgcccgcgccatcgcggcgcgacacctttgccgtgcaaaggtgagggggttatccaaaaaagtttctacggaacttttttggtatctaagggggacagagtcccccttagagggtcttacataccaacgtaagcgccgttcttgataaccatgcccttcggggacttggatacggcaccggtctcatcccaggtcatgccctcgccggtcaggccgtcaaaggtcatggaggtgaactgctcgatcatcttgtcgcacaggtcctcagcggacatatccggcgtagcgcctgcattctcgagtgcctgcttgtaagcgtaaacacagtcgtaagcgtcggctgcgaactggttcggggtttcaccgaactgctccttgtacttcttaacgaaggaagcggtcttgtcatcggttgcgtctgcgttgaacggggtcagcagcattacgccctcggccagcttgggatcaaagccttccatggtcagaatgccgtccatgccgtctacaccgaagaacttcggcttgtagcccatgctgtttgcctgggtcaggatcagggatgccggctgatagtacatcggcaggaataccaggtcagcgcccttgctctttgcgtcgttcagctgaacggagaagtcgttagcggaagcgtcggtgaaggtgttgtcggaaacgacctgcaggcccttggtctttgcctcttctacgaacttgtcgtgaatgccggtggagtaaacgtcatcgttcttccagatgacagcgatcttggtgccgagcttctgctctgcgatgtactgcgcggatgcggtgccctggttcgggtcaacgaagcacatctggaacacattgtccttatctgcggttaccgcaacggtggaagcagacggagtcagtgcgaaaatacggtcgctgtagttctcagcggcggtagcctcgcacggcttggaggttacggagccgagagacagctgcatgccccagtccttcagggtgttgtaggcgttgacagccttctcggcgtcgtgctcatcgtcctgatagttcagctcgaactgaatatcgccgccctcagcgttgatctcgtcaaccgcgatctgtgcgccgttcttgcaggcgttgccgtaaatagcagccgcgccggtcagcgggccggtgccgccaatcttgaaggcagtgccggaagcggtgctgtcggagttgccgctgttctgcgaatcggagctgcccgaagcggagccgccgcagccggtcagcgccgtagccagcatagcgccggcaagaagcatactgagtgttttcttcatggtgaaatcttctcctttgtttcccccgaatcagcatatcctatcgggtgtcttggattatgcttcacattatactaccatttccgcgtttcggcgcactttttttgtgctgagaatacaatttcagataatctactgattatcttttgagtaactttacgttttttgtatcttctcacaagaacacttgtccgccctgcaaggattcctgcaaattacttccatcctgccgccgtttttgcagggagagtccgcaaaatttttctcacactgagaaccgcataagcgcccttcccctttcataaattggattgactcggcatgccgtttcaaacaatttgcatgtacaccataccgattacgatattcattcaatctgtgcaaaatttcaaggagggtaccccatgaccgaaaaacgccacggaaaaggactgttattcatcgtaacgctggttctcgctgccggtgtgataaagtacgccgacatccccttcgcgcagaccgtgcgcgaaaaggcggcttctgccctgtccggcgcggcaaatgctgaccatgttcttgcggtattcggcggctctgccatgcccgcagataccgttcctgcggaatcctccggtggtgcggacgatatcttagaccgcgaccagaccctgttccccgacacggttgatcagaccgtctatccgctggagttcaagcacgccacgccgacttccggcacgctgacgtcctctttcggcagcaggctcagtcccatcaccggtcagccgggcttccactacgggcttgaccttgccgcggacgagggcacgcccatcaccgccttcgcggacggcacggtgcgcgagaccggcgaatccggctacggcctgtacatcattgtcgatcacgcggacggttttgcaaccttatacgcgcactgcagcagcatttccgccaaagtcggtgataaagtgacctgcggcgagcagatcgccaaggtcggtcagaccggcaacgccaccggtccgcacctgcacctcgagctgtggcacaacggcgcggcgctcgatcctgccgactatcttgcgctgtgagccggattcaggtccgtgacggctttcttgtgctcatggctgcgctctggtgcgcggatgagagcggcgtgctgcccattttcctgctggcggcggctgtacatgagtgcggacacctgattgtcattcggctgtccggcggctcggtgcacgccctgtgcctgaccgcctgcggtgctgtcctgcggtgcagcctgccgccgtcgccgttttcgcgcgccgccatctgcctcgccggaccggcggccagctttgcgctcaccgcactggcgaacccgctcggcgtgtaccggcttgccggcgcgagtgccctgctcgggctgttcaacctgctgcccgtgcccccgctcgacggcggcatggcactccggcacctcgcggacggacggtttacacgcctgctgaacgggattgcgggcgtgtccgttctcgtcctccttgcgggcggcgtcctcctgtggaagtcgggatttggcgggtggctgtttctcgctggattgatggtcgccgtttcctttggacgcgcaatatcaaaaaacaagggcatcaatcaaatccttgacgaccggctccgattgccggggttgtaatctgatgatgcccttgttttccataagagtacctgtcagctcctggacaaccggctccaattgccggagttggtggctgatgatacccttgttacctataatatacgccaaaacgatgaaaatatcaatatatgtgttatccgtttacaatatttcgcccggttttatgtaatgcaccagcgttaccgtagggtgcgacgacctcggcgcaccgtatgtaacccacatgcacacgcataaccgtaggggcgaacattgttcgcccaaaaaccgtgcgattttacgttgtgtgggagcacactgtgctcccctacgggataacgtgtaccaaatcgttaaaattcggtgcgccgaggtcgtcgcaccctacggcaacgcttcaccctcgcgttaattactaattattctgcgctcttgtaaattttgccgaaatcgtgtaaaataacggtacaaagatttatccaaacaaaccaaaaggctcacaaagcctttggatagaaaggaccgaacaattatgctgggaaaacgcagaaaaaaaactgatctccccgccgtatgcgctgttatcgttgcggcaggctcctcccgccgcatgggcggcgaaaacaagctgctgctcgagattgacggcgtacccgtcctcgcacgcacgctttccgccttccagaaatgcgccgccatccgcgatatcgtgctcgtctgccgtgagcaggacatcatgccctataccgagctggcgaaggccttctccatcgacaagctgtgcacggtaacgcgcggcggcgagacccgcacggaatccgttctcgcgggcatcacggccgcaccggaaaacgccgtgctcgttgccgtacacgacggcgcccgcccgctcgtctccgaggccgttatcactgaggcggttaccaccgccgccgagtacggcgctgccgcgccggtcgttccggtcaaggacagcatcaagcgcatcaaggatggcaatatcgccgccgatgtcgcccgcaacacgcttgccgcggtacagaccccgcaggtattccgcaaggacctgctccgccgtgcgctcacctcggctgccgagcgcggctacagcttcaccgatgactgcgcggctgtcgagtcgctcggcaccatcgtcaaggcgacccacggcagctaccagaacattaagatcaccacgccggaggacattctcgttgcggaagcgctcctcacaagggaggacaagtaatatgcgcatcggacacggttacgacgtacacagactggtctccggcagaccgtgcatcatcggcggtgtgaacattccgtttgagcttggtctggacggtcactcggacgcggatgtgctcacgcacgccgtcatggattccctgctcggcgcgctcgcgctcggtgacatcggcaagcattttccggataccgacccgcgctacaagggcgcggacagcatcgcgctgctgcgtcacgttgccgcgctcgtgcgcgagagcggctggcagctcggcaatctggatgcgaccgtgctcgcacaggcgcccaagctcgcgccgcacattctgcagatgcgcgagaaccttgccgccgccatcggctgcgcggtcgagcaggtttcggtcaaggcgaccaccgaggaggggctgggctttaccggctccaaacaaggcattgccgcgcactgcgtgtgccttttagagcgaatctgaacagaccccatctactatgataataggtaggggtaacaccgcatagcggtgttgcccccccacaaaggaagtgaacccaatggatatacaggtaaacgacattcttaccatgaaaaaacagcacccgtgcggcagcaagcagtggcaggtgctgcgtatcggtatggatttcaggctgaaatgcctcggctgcgggcatgaggtcatgctgccgcgcagcaaggcggagaaaaacatcagaaccgtagaacgggagggtgaaatcgtatgttgatcgacggcaagcaaatgcacattcaaatcaccaagggcgatatcgggcggtacgtcattctgcccggtgacccggcgcggtgcgagaagatcgcgcagtatttcgacgccccgaagcagatcgcgcacaaccgcgagtacaccctgtggacaggctctctggacggcgttccggttgcggtatgctcgaccggcatcggcggtccgtcggctgccatcgccatggaggagctggtcgagtgcggcgcggacacgttcatccgtgtcggcacgtccggcggcattgtggacaaggtaaagggcggcgatatcgtcattgccaccggcgccatccggcaggagggcacgagccgcgagtacctccccatcgagttcccggcagtcgcggatttttctgttgtttccgcgctgcatgaggcggcgcaggcgctcggcttcccctatcacacgggcgttatccagtccaaggacagcttttacggcgaaattcgtcccgcgcagatgccaatcgcggacgagctgaccgccaagtggaaggcatggaaggcggcaggcgcgctcaccagcgagatggagacagccgcgctcatgatcgtcgcgcaggtgctgcacgttcggtgcggcgcggtgctcaacgtgctgtggaacgccgacaatgacgatgcgccggccatcccgcctgacgccaccgagcgcggcgtaaaggccgccgtggaagccatccgcgtgctcatccgtgaggacagcaaggcatgagtgaacaacagaatcagcagacagcggccctcggcacagcacccgtagggccgctgctctttcggctggcgctgccgaccatcacggcacaggtggtcaacctgctgtacagcatcgtagaccgtatttacatcggacgcatcccgctcgagggcaagctggcgctgaccggcatgggcgtcaccttccctgtcatcacgctcatctcggcgtttgcggcgctcatcggcatgggcggcgcaccgcgggcgtctatcgcgctcggcgcaaaggagcacgaccgcgcggagcgcatccttggaacgtgtacggcggcgctctgggcgcttgcactcgtgctgacagcacttttcctgctgtttcaggcgccattactgaaactgttcggcgcatctgccgacaccctgccgtatgcgatgcagtacctcaacctctacgttctcggcacggttttcgtgatgacatcgctcggtctgaacggcttcatcaccgcgcagggccgctcctcggttgcgatgaaaaccgttgtcatcggtgcggtgctcaacaccgtgcttgacccgctgttcatcttcgtactgaaaatgggcgtgcgcggcgcggctgtggcgacaattatctcgcaggcggtgtctgcggcatgggttctgcggtttctgaccggaaagcagacggttctgcgcttaaaacgcgcgtatttccgcattgaccgaccggttctggcatccgcagtcggtctgggcgcgtccccgtttgtcatgcagtcaacagaaagcctgctcaccattgcgttcaacgtatcgctgcaaaagtacggcggcgatgcggcggtcggcgcaatgaccatcctgacctcggtggcgcagatggtgcagctgccgctgaccggactcgcgcagggcgcgcagcccatcctcagctacgcctgcggcgcgaagcggcccgaccgcatgaagcgcgtcgtgcagctgaatctcgcggcggcgttcgtgttcgcgttttcgatctgggcggtggtgcagcttgcgccgcacgccgtcatccacctgttcacggcggacgaggaactcgtgtcgctcaccatctgggcgctgcgcgtatactttgcgctcggatttaccaatgcgttccagaccggattccagcagtcgtttgtggcgctcggcgaggcgcgtatctcgctttttctcgcgctcgagcgcaaggttttcctgctgataccgtttattttaatcctgccgcactttttcgcggataagctgttcgccgtgttcctcgcagagccggtcgcggatttattagctgcggctacaacgacaacgctgtttttgattcgattcaagcagatcacgcgagatatgtgagccaatttccctgcatcggctgtgcggagtacacgaggcgcgtagcgctacgccctatccgggaggcagcctttttcagcaccgacccagcagggtacttgaaccgcgcacgcggttcaccctatccgggcggcagtctttttcgctgaacctcagcagggagttgcgctgacgccgcgcgggcgcacaagagggtagacacctgcggtttccaccctcttgtgaatcacccctttcccttggatagtctggcgcagattgccgacatgtgaccgcttcgaaataaggggaacggcagtcgggttaccacagcatgtctttctccgccttttcgcagttcacagacagcgtactgctacacatacggttaaatccacgcaggcgcggcatagcagtgccgcgcaactctttaacgtgttataccggacagcacctacggattaggcgtttgatactatttatcttcgcaggtgctgtctattacaacgcgctcacgaattgcgcgacacgggtatgtcgcgcctgctggaagtagccgacctatgtagcagtacgttatctgaccctgcgaacaggttgcgaaagacacggaagaaaaaatcctctgccgttcctcttttcgaagcggtcacatataggcaatctgcaccagattaggaagcaagggaaaggtaggagtccaaagaggaaggaaaaccgcaggttgtccttcctttttgcccccgcggcgggcgccgcgacgttcccgccgtccgcagacggcgaatccccttgctgaggttcagcgaaaaactccccacccggatagggtgaaccggctgcgcggttcaagtaccccgcttagccggtgctgagaaaaaaggtgccgcccgttaggggcgaacacgcttacgcagttcgcgtgccccggtcaatccctgccgcgaaattttgagatacaaaaaaggctccggatatgctccagagcctttctctatgcaatttcagcgcaaattaaccgtttaccgctgccttcagcgcctcaaccttatcggtattctcccacttgacgccaagctcctcgcggcccatgtggccgtaggctgccagctgcttgtagatcggcttacgcaggtcaagctgctcgatgatcgccgccggacgcaggtcgaacaccttctctacggccttctcaagcacatcgtcgccaacaacgccggtgccgaaggtctctaccatgatggaaaccggctcggcaacgccgatggcatacgccagctgaatctcgcagcgcttggccagacctgccgcaacgatgttcttcgcaacccagcgagccgcgtaagcgcccgagcggtccaccttggtcgggtccttgccggagaacgcgccgccgccgtgacggccgatgccgccgtaggtgtccacgatgatcttacggccggtcagaccggagtcgccgtgcgggccgccgatgacgaaacggccggtcgggttgatgaaatacttggtattctcatccagcagatgggacggaatgaccttctttaccacctgctcgatcatgtcctcacgaatctgcgcgagggacacctccgggctgtgctgggtggaaataacaaccgtatccacgcggacgggctgattgtcctcgtcatactctacggtaacctggctcttgccgtccggacgcagatagtcgaacgtaccgtccttgcgaacgtcggtcaggcgctttgccagcttgtgcgccagagagatcggcagcggcataagctccttggtctcatcgcacgcatagccgaacatcatgccctgatcgcccgcgccgatggcgaggtcagcctcagaggcaccctccttgctctcaagggagttgtcaacgccgagtgcaatgtcggcggactgctcgtcgatggcggtcagaacagcgcaggtgtcgcagtcaaagccgtacttcgcgcggtcgtagccgatctcacgaaccgtgtcgcggacaaccttcgggatatccacatagcaggaagtggaaatctcgcccattacctgaaccataccggtggtgcaggtggtctcacaggctacgcgggcatacggatcctgcgttaaaatctcgttaagaatcgcgtccgagatctggtcgcagattttatcgggatggccttccgtaaccgattccgaggtgaaaaaatgatgtgccattaagtatcagttcctttctccagttcattttcagagcattaaaaaacgctcctcagcgggagcgaaaagttcgttttgctccctcatctttcgtattcttacgccggatttggcaccttacgttgcaaaacaacgcaggttgccgggtttcacagggccgttccctccaccgctctcgataaggacatgtattcacttacgccgtatattttatataaaaattccggctttgtcaagggaaattttcggcagccaagtggaaaagcgccgcattgacattttccgctcacaccgttatagtaataaaggtaagattttgccctgcatatttatcacatcacacggctctttcagcccgatgcacggcagagcttacccgcattcacgctgcaccttaacgggtgctctgttttgttatgggagagaattagggtattatgaatgtaaatgttggaatcgacatcggctcaacgaccgtcaagatcgttgttgtgcgcgatggagagatcatccacaagcactacgaacggcatttttccaaggtgcgtgaaaaggcggtcgagctggtgcgcgcggcgcgcgacctcatcggcgaggacacgccgctccgctgttcgatcaccggctcggccggtttaggcgtggcgaaagccgcggatattgattttgtacaggaggtgttcgccacccgcaaggcggtaggcgtacacgttccgcaggccgatgttgtcattgagctgggcggcgaggacgcgaagatcgtcttcctcaccggtcagctggaggagcgcatgaacggctcctgcgcgggcggcaccggcgcgttcatcgaccagatggcggtcctgctggacgttacgccgtccgagctcgatgaactcgcacagggcgcggagcgcatctacaccatcgcgtcccgctgcggcgtattcgccaagtcggatattcagccgctgctcaacgagggcgcgcgcaaggaggacgttgccgcgtccatctttcaggcggtcgtcaaccagaccattgccggtctggcgcagggccgcgaggtcaagggcgatgtgctgttcctcggcggcccgctgttcttcttcaagggcctccagaagcgctttcaggagacgctgaagctggatgatgcgcacgcgcacttccccgccctcgcgccgtatgccatcgcggcgggcgcagccgagtacgcaggcggcacgcagaagacctacacggtcgattcgctgctcgcggcgctcgaaaaggcggcagacgctccggtcgttgccaactacctgccgccgctgttcgaggatgagcagcagtacgaggaattcaagaaccgtcacgccatgcacgatgtcatgacgcagaacgtcaccatgtacgagggcgacgcatatctcggcatcgactgcggctccaccaccaccaagctggtgctcatcggtgaggacgaccagattttgttccaccactaccagtccaacaagggcaatccggcggacgttatccgcgagcagctcaccaagctgtacgagctgtgcggcgaccgcgtacatatcgtgtcctcggcggtcaccggctacggcgaagcgctcatccagaatgccttcggcgtggatttcggtctggtcgaaaccgtcgcgcacttccgcgcggcgcgccatttctgcccggatgttgatttcatcatcgacattggcggtcaggacatcaagtgcttcaaaatccgcaataagtgcatcgacaacatctcgctcaacgaggcgtgctcgtccggctgcggctcgttcatcgagacgttcgcccgctcgatgggctactccatcgaggaattctgcaagctgggtctgttcgcaaagcaccccatcgacctcggctcgcgctgcacggtgttcatgaactcctcggtcaagcaggcccagaaggacggcgcgggcattgacgcgatttccgccggtctgtcggtttccgtcgtcaagaacgcgctgtacaaggttatccgcgcccactcgccggacgacctcggtcagcacattgtcgtacagggcggcacgttcctcaatgacgccatcctgcgctcgttcgagcaggagatcggccgcgacgtgacccgcccggctatctcgggtctgatgggcgcatacggcgcagcactgcacgccaaggacaaccgccgcgacaccaccacgctcatcggcacggatatcctcgcaggcttcgagcacaacgtgcgctccacgcgctgcggtctgtgcgagaaccactgcaatctgacgattaacgacttcggcggcggccgccgcttcatttcgggcaaccgctgcgagcgtccgctcggcggcacgaaaaaggccgacctgcccaacctttataaatggaagctggaaaagctgaaaagctacggtgagccgtccggcattgcaaacccgattgcaaaaatcggtctgccgttcggtctcaacaacttcgagctgctgccgttctggacggcattcctgcgtaaactcggcttcgagaccgtcctcagcgacgtttccacccgcgatatgtacatgcagggtcagcattccatcccgtccgacacggtttgctatccggcgaagctgatgcacggtcacatcgagaacctgcttgaaaagggcgtggacgcgattttctatccgtgcatgacctacaacctcgatgaggaacgcgcgaccaaccactataactgtccggtcgttgcctactatccggagcttttgaaggcgaacgtctccgcactcgcggacttcgactttatgatgccgtactttgaactcgcggacaaaaagcgcttcacgaagcacgccgttaagtatttctgcggcaagtacccgcagatcaagaaaaagcaggtcatcgccgctgtcgaggaggcgtacctggcgcaggacgaatactacattgacgttcgcatcgagggtcagcgcgccatccgctacgcggacgagcacgaccttgacgttgccgttattgcaggccgtccgtaccacgttgacccggagatcaaccacggcatcgaccagctgatcgcgtcgttcggtctggtcatcgtgtccgaggatgcggtctggcagctgaccgatgcacccgaggtgcatgtgctcaaccagtggacgtaccactcgcgcatgtacggcgcggcgaagtacgtcacccagaaggagaacgcccagcttatccagctggtgtccttcggctgcggcattgacgccatcacgaccgacgagatgcgcgccatctgcgaaaacggcggcaaaatttacacacagctgaaaatcgacgagatcagcaacctcggtgcggccaagatccgtatccgcagtatgctggccgccgtagaggagggacgcaagcttgcagaacagcaaaacgcctgaggcaacgcccgcatattcctacccgcagttcacggaggaaatgcgaaaaacctataagattctggtaccgaacatgctgcccgtgcagctcggactcatctgccgcctgatgaaaaactacggctacgacatggagctgctgcacaccgagggtccgaacatcgcggagcagggtctgcgcaacgtgcacaacgacacctgctaccccgccctgctggtcatcggtcagctgatggacgcgatcgagtccggtaaatacgacatccacaaaatcgcgctcatcctgccgcagaccggcggcggctgccgtgcgtccaactatatccacctgctccgtaaggcgctggaaaagaacggctacggcttcattccggtcatttcgctgaacttttccggcctcgagagcaaccccggcttcaagctgaccaagaccatgctcgttcaggtggcgtacgcgcttctgatcggtgatctgatcatgatggtcgccaaccagtgccgtccgtacgagatcgtgcccggctcgaccgacaaggcgattgacatctgcatggacgcggtcatcaagcgcttcaccggcgagcgcatggtgcgctacggcgaggtaaagcacctgttccggttcgttctgaccgtattcggcaagctgaagctggataaaacgcagaagaaaaagctggtcggcatcgtcggtgagatctacgtcaagttctcgccgctcggcaacaaccgtctggaagaattcctgctcagcgagggctgcgagccggtgctgcccggtctgatggacttctgcctgtactgcatctacaactcggtcatcgaccacgagctgtacagccgcaacggcaaaaccgccgccatctacaagatggtgtaccagtttgtgctcggcaagcaggccgatatcatcaaaatgatgaagaaagacggtcatttccgtccgccgatgccgtttgacgaggtacgcaaaaagtcgcacgccattatcggtcagggcgtcaagatgggcgaaggctggctgctccccgccgaaatggtcgagctgatcagcgaaggcgtgaccaacatcgtctgcacccagccgttcggctgcctgccgaaccacatcgcgggcaagggcatgatccgaaaaatccgcgaggtgtacccgcaggcgaatatcgtcgcggtggattacgacccgggcgcatcgaaaattaaccaggaaaatcgaatcaagctcatgctttcgagcgcagagtaaagcaaagaggactgcaaacgcagtcctctcagtctgtcaaaaaagtagtattttaatttttacgcttcgtgcagcagcaggcataaaatagaatttgcgaagcaaattcataattcccgggggcatgtacctcgggaattatacaagggaagaaaaaatgtgcccgtagggcgcggtttttcttcagtattcgctcgaaagcgtggtttcgagcgagaggctgctcggaaaacgatagtttttcgacagcctcagaggactgcaacgcagtcctcttttttatccacagacggtggataacttattcatcgatgatggtggtgaaggtcaggttttcgctttcgttcgggggcaatttgcggatgccctgcttgtgctcgatggcatggtcaaggtgattgccgtccggcagggtgctccacggctcgaggcagacgaacggcacctcgaaatccttgtacgggctccacaccgcgaaatagtcgaagtcggtgaagtccatcgtcacacggcggcggttcttcgtgctggcaatggttgccgtgcggaacggcagaccctcggtcatgaccgcatcgtttgcaaacagctcgcgggaaatcggcagtctgccatcggtcagcggaacggaaacgcggtcggcggtcagcatgacgttctcgtcggttgcaatgcggctgagcgcgtccgtgccctcaaactccacatagtagtcggttatcttctcgccgtcctcccagcagagcgtgtaggcgtcatggccgccaacttcgtaatacatcacggaatcgctcgtattcttgacgatatgctcctttttcagcgcatttccgtccaaagtatagcgcacggtgcagataaaatcccacggatacatctttttcgtgtactcgctcggcgtgagcgtgaattccgcacaggtgccgctgattttctgtgcctgccacgccagatcgcgcccgaagccgtgctgcgtgatctcatacggcctgccgtccacggtgtaggtcttgtccttgagccgtcccacgatcgggaacagaatgggcgcatggcgcttccatgccgccggatcgcccttccagatgtactccgtgccgtcctttttgctcgtaaagcgggtcagctcggcaccgaattcgttaatttccacgcgaaagcgttcgttttccaatacctgcatgggtttttcctcctttacttgaggcaataccacataattaaagctgcggcgctttacggaaattttgtgtcctgactttgttgcgatttcttgtaatacgtcaagtattgctgcgaaaccgcgtcgcgtcagtacgcaaaatttactcgcaaatcgcccttgttcaattatgtgatattaccttaagttcaggatacccactttatccggtaaagtcaagaaaaaaggacgaaccaaacggttcgtcctttggaggctgtcaaaaaagtattattataatttttacgcttcgtgcggcagcacgcataaaatagaatttgcgaagcaaattcataaattccgggagcatgtatctcggaatttatacaagggaagaaaaaatgtgcccgtagggcgcggtttttcttcggtttcgctcgaaagcgtggtttcgagcgagagactgttcggaaaacgaagtttttcgacagtctcaaaaggacgaaccaaacggttcgtcctttgcttttactcaagctccgaaatcgctctgcggattacggcatcctgctgctccacggcgtcgagcaggctcctgtcctcgagcggcttctcccctctcatggcctcggtcagcacagcgctgacctgatacagccgctcaaagccgaggttctgcgctacgcccttgagggtatgcgcaccgcggaaggcagcttcccagtcctgctgcagagccgcgttgtgcaggtcggcgcaggtcgggtcgtcctgatacttcttcacgaactttttcaccatgttctcattgcacaggcgctgcagcgtgtccgcataatcgccgccgatctgtgcataaaactcttccagattcatgtatgtactcctcctcaggtctgtacgtcgttgcgcttttgctttgcccagtacatcagcttgtccgcccggcggatggcctcgaccagcggatgcgcctgatacacaccgccgatgctgacggtcgggtggatattctcgtactgcggtatttcggtcgtgtacacggctccccgaatgcgttcgagtatcgaacggaatttctccggcgggatatgcgacagcagcagcacaaattcatcgccgccatagcggacgagtgtgtccgctgtgttgacgcgcgagagaatgacgttcgcaacgtgccgcagcaccgcgtcgcccgcaaggtggccgtattcgtcgttgatctccttaaggttgtcaatgtcgatcaccgccagcgcctccgccttttccagctcgggctgctggtcctcgaggtagcggcgcccgtatgcgcccgtcaccgggtccagataaaaatcctctccgtgcgaggcatccagccggaactgccgtccgccgctcgtcacccaaacgctgtcgctgagcctgctgcccagctcgagcacgcactcgcgtccgtccacgaccagatagcgcgaaatcagctgatacgcgcactcgtcggtaagctccagcctgctcatgcgcgtcttttcctccatgcagcggcgggaaatgcatctgctgcatcgttttccgtggttacacaccggaaagcacggcaggacgcggtccgagaacgtgccgtccgtattcagctgcaggagtttgccccttttgggatcaaccagccgcaccacatcaaaaatgcggctcatgccctgcatggaatccgcaagctgcctgccggtgacagcgccggaatccggcagctgcatctccggcagcatgatatcggtctgcagctcgcggaactgaccgacagcgccgagataccgcggcttggcgtcactcgaccagagcgcacgagccgtgagcatgtactcgtgttcccagccgacctccggaaaccgcagggtgatcggcatgctgacatccggagcatcccgcgttgtagcagacagcgcgttttccaggcggttcaggtcatccttgctgaatatcgtgaatttttccgtatccgccgcatcatacaggcggctggcaaacggcagcgtatccgtgtggtccgtcacagagatggtgcgcgttgccgcgtcatagtcgaactgaatgccgcaggactgcttggcaaagaactcggtcttgatgcgctcggtctcgagcgcctgaatcgaacgcccgacctgcggcgtcgcctgcttgagcagcatttcggtcgaaagctgctgcgtgtgcgccgtgctgtgcgtatatccctcgttcgcctcgagcagacgctccctgatctgcagcgacgcatcgagcaggcactcgagcagcagcggattgaacgtgccgcactcgccgtttacgatcatccgcagggcggtctcgtggtcatacgcggacttgtagcaacgcacgcttgtcagcgcgtcgtacacatcggcaaccgaaacgacctgcgccgcgatcgggatctcctcgccggtcaggccgtccggatagccgcggccgtcgtagcgctcgtgatgccagcgcgcgatctcatacgcggtcttgagcagcggctcctcatttgagaacggcaggtcgtgcaggatatccgcgccgaccgtcgtgtgcgacttcatgatctcaaactcttcctttgtcagcttgccgggcttgttgatgatctcatccggaatactgaccttgccgatatcgtgcagcgcggacgcactcgagatcagctgaatatcctcctgcgtcagcgaatagcggtcggtcttctgcaccagacggttcagcagcacctcggtaatggtgcggatgtgcagcacatgcgggccgctctcgccgttgcggaactcgacaatatggctgaagatattgatcatcaggtcgctgatcttctctttttcgtaaatctgctcggcggcaagccgcatcagccgcttctgtttggcagccagtatcagcgcgttgaccacgcggcggcgcacgaccatgcagtcgaacgggcggctgatatagtcggtaacgccgaggtcgtacgcgcgctcgatgtgctcgatgccgttctccgccgagatcatcaccaccgggatatcctcgatctggcggttgttgttcatcgcggtcagtacgtcaaagccgttcatctccggcatgaccatatccagcaggataaggtcgatatcggtgtgcgtccgcagcagctcgatcgcgcgggcgccgttttccgcctcgataaaattgtattcgtcacccagaatatcggctaagaccgtgcgattcagttcggaatcatctacgatcaaaatcgtgcttttctctttcattcgtgctaaaacctcctgccggtcaagcaatagatgccgtgattgattgatcacaggccgcataaaacaaattgtgttcctgcatgcatctgcatgcataaaagccgaggtctgcagggcagaaaaccggcagggataatgctaaaagaatccattagtatgataacattctttgcaggttgatgcaagctgttttgttttggaaatgcagatttttcaactttttacacggtttaccctaaaaaaacgcactttctgcctgcttttcagcctgtcagtgtaaacatgcagtgtatcagtatgcaaagggcaagcccgattcccgcaggaatcagcaccgccgccagtgtccactttgcgctgcgcgtctcccgcaggatggtaaggcaggttgtcgagcacggcgcgtgcgccacagtgagcaccagtgtgcagagcgcggtctgcaccgtccagccgtttgccagcagcagcgcgcggaaggaggcaaagtccacgccggaggcgatcgtgccggatgaaaggtagcccatcacgatgagcggcatgaccagctcattcgccggaaagccgaggataaacgcaagcagtatcacgccgtctatcccgaacatccgcgctgccgggtctaaaaatgccgtgatgtgcgacaggatagcggtattccctatctgcacattggcaagaatccagatgagcacgcccgccggagccgccacggcggcggctctcgcaaggacgaacagcgtccggtcgcgcacgctgcgcacgataacgcgcccaatctgcggcatgcggtacggcggcagctcgagcgcaaacgacaccgcctctccgcgcaaaaccgttgccgagagaatgcgcgacacgagcagcgtcaagccaacacttgccgcgatgacgccggtcagcagcagcgcgccgcctgccgcgctgcccgcgaagaacaccgagcacaggaaaatgagcagcggaaaccgtccgttgcacggcgcaaagctgttggtgaggatggcaatcagccgctcccgcggcgagtcgatgatgcggcagccacttacgccgcaggcgttgcacccgaagcccatgcacatggtcaggctctgcttgccgctcgctctcgcgcactggaaggcgtggtcaagctgaaacgccacgcgcggcaggtatcctgcgtcctcgagcagcgtgaacagcgggaaaaagatcgccatcggcggcagcatgaccgagaccacggttgccagtacgcgccacagcccgtcggtcagcatcgagacgataaacggcggcagtcccagcttcgcaagcgcacccgcaaacggcgtgccgagtgccagaagatgcgtgctcagccactcgctcggcacgtttgcgccgaatagagtgatgtaaaacacgcctgcgagcagcaaaagcatgagcggcacgccgaacctccggctgaggatcacatcgtccgctcggtcatcccgcgcgcaggcgcattccggctgtctgacgcacgtcagcgcgatctcctccgcgcggagtgccgccgctgcggttgcaatatcgtccctctgttcctccgtcaaatcctcgtccatcgccggatagcgaatggcggtcgggtgcgtttcattttcgcctgccgccgctcggcgtatcgcggcttcaagctcgtgcagaccctttccctgccgtgcggcgcacggtatcaccggtatgccaagctcccgctcgagcgcggcaacatcaatctcaatgcccttttttgcggcttcatccatgagattcagacacagaatggcgtttttctgtacctccagtacctgcaaagcgaggatgaggctgcgctccagacagcccgcgtccgccacgagcaccaccgcgcacgcctgacccgaaaccagaaattcccgcgcggcacgctcctcctccgagtgcgcccgcagcgagtaagtacccggcaggtcggtcagcgtcagaccgccgccgcgcagcctgccctcggcgcacacgactgtttttccgctccagttgccggtgtgctgacggctgccggtcagggcgttgaacacggtcgatttgccgacgttcgggttgcccgccagcgccacggtgcgcctcatggctgcacctcgatttgagcggcatcgcatttacgcagggcaaccaccgcgccgcgtatccggtacgcgatcgggtcgcccgagagcgcacgccgcacacaggttacgcgcgtgcccggcactaaccctaaatcctgcacgcgccgccgcatgccgccgctgagatgcagcgccgcgacccgcgcctgctgtccgtcccgcagcgccgacagcgaaatatttgccgaatctgccatccaatcagccccttatccatgatttctgcttacagactatgcacttttgcgaaatttggtgctactctgccctgcctgcacatatagtaaggcagaccccaaaggaggctcggctgcatatgaaaacaagcgaatcctatctgcctgagggcagctacatggtacagcctgcggttcggcaggcattttcaacgctcagcgcactgcggcaggcgcaggacgagggacgcattctggaagccgtcgcacagcggtgcaccgccgcgcacgacctgctgttcgacctcggcatcgcgcagggcatcctgccgcgcgtgtcctgcgcgctcggcgtggcggagggcgacacgcgcgagattgccatcctgtcgcgtgtaggcaagcccacctgcttcgtcgtcaccgatatcgacgagagcacggacccgcccacggcgtggctgtcgcgcaccatcgttcagcagaaggcgcaggaccggctgctcgattccctccgtccgggtgacgtgattccggcgcgcgtaacgcatctggagccgttcggcgcgttcgtggacgcaggctgcggcgtgccgtcgctcatcggcatcgaaaatctgtccgtgtcgcgcatctgccacccgggcgaccgattgaccgtcgggcaatccattctggcggctgtccgcaccgtggagccggaaaaccggcgcatttcgctcacccaccgcgagctgctcggcacttgggcgcagaacgcggcgctgttctccgtcggtgagaccgtgcgcggcgttgtccgctccattgagccgtacggcgtgttcatcgagcttacgcccaacctgtccggtctcgcggagccgcgcgcggacctgcggcccggcatggcggtatccgtgtacatcaagtccatcctgccgcagcggatgaaggtaaagctgaccgtcatcgacgttctcgcgccgtatgacgcaccgacaccgccacggtatttcatcaccgaaggacatatcgacgagtgggtctatacaccggcgtgctgcgataaaaaaattgttaaaactatatttggataacccttaccgtagggcgcgacgactcggcgcgccgttcgtgacggtgtgcagacggtttatgcggcgcgccgaggtcgtcctccagaggaccatctcttgccctgcagggcaattcaccttgtcgcgccctacgaaaaacgtaccaaaggcaatcaacgcaaatgaaaaaatggagaatggaaaatctacacattcattctccattctccattttcaattctcaattatttcgagcccttgaccttattccagtacgctttcgcggcctgttcggtcttattgggcccgaactcgtagtatttcgtgccgcgcagctcctcgggcagatactcctgctgcacccagtgattaggatacatatgcggatactgatacgtcaatccgcggcctaatttctttgcgccgccgtaatgcgtgtccttgaggtgcgccggaatatcgccggccctgcccgcccgaatgtcggcaatggcggcatcaatgccgttgatggcactgttggacttgggcgcggtcgccatcaaaatgatcgcctccgcgagcggaatccgcgcctctggcaatcccagctggaacgcgctgtccacgcacgccttaacgatggcggcgcactgcgggtacgccaaaccgatatcctcactcgcaatgaccagcatgcgccgcgccgcggagatcatatcgcctgcctcgagcagccgcgcgagataatgcagcgccgcgtccgggtcggagccgcgcacggacttctgcagcgccgagaggatgtcataatggctgtcgccgtcgcggtcgtagcgcatattcgagcgctgcgccgcctgctgcgcgtccgcgagcgtgatgccgtccgcccccgcaccggagacgagcagctcgaccgcgccgagcgcctttcgcacatcgccgccgaccgcctgcgcgatgtaatccgccacgccgtcctcgaccggctttgcgtcctcgcccatcgcaagtttcaacgcacgttccactgcccggcgcatatcggcagcctcgaccggcttgaactcgaataccgtgcagcggcttaaaatcgcgttgtagatgtaaaaatacgggttttccgtcgtggacgcaatcagcgtgatcttgccggtttcgatgaactccagcaggctctgctgctgctttttgttgaaatactggatctcatcaaggtacacaagcgcaccgttcggcgcaaggaaggtgtccagctcgtcaatgatcgccttgatgtcggcaatgcccgccgtggtggcgttcaggtggtacagcttgcggtcggtctgctgcgcgatgatggacgcgaccgtggtcttgcccacgccggacggcccgtaaaatatcaggttcgggatgctgccgctttcaatgacgcggcgcaaaaggccgttttcgcccagtaaatgccgctgaccgaccacatcgtccaaagtcttcggacggattttgtctgctaaaggttggtacataatttaacccttcattagtcgtttaatgtctatcagagtggagagtgaggagtgaagagtgaagatttactcaccgagaacacggaacccgccgtatctcacgttctctccactcttcaatctccactctccactctattataaggattataccacatctcacagttatcgacaaacccctcttgactttatcgctttattatgataaactatccccatcaaagaaaacgaacacaggaggtcttcccatggacaagccttttctcgataagctgcgcaagatcgacccgtatgtgccgggcgagcagccgaaaaccgccgatatcatcaagctgaacgccaacgagaacccgtacccgcccgcgccgtccgtgaccgaggttctgcgcacatttgacgccgcaaaactcgcaatttacccggatgcgaacgcgaaagcactcaaaaccgctatcgcagagcgatttgacctgcagccgtcgcaggtattcctcggcaacggctcggatgatgtgcttgcgctggcgttccagtcgttcttctgctcggacaagcctattctctatccggacatcacctactcgttctatccggtgtggtgcgatctgttccgcattccgtacgaaaacatgccgctcgacgaggatttctgcgtcaatgtgcgtgattacgacaagccgaacggcggtatcgtcctgccgaacccgaacgcgccgaccggacgcggcgtaacgctcgagttcctcgaggacctgctgcagcacaatcaggactgcgttgtcatcatcgacgaggcgtatgtggacttcggcgcacagagcgcggttccgctgctggataaatacgaaaacctgctcatcgtgcagacgaccagcaagtcgcgctcgctcgcgggcatgcgcatcggctatgcgctcggctcggagacgctgatttccacgctcgaagcggttaaaaactcgtacaactcatacacgatggacgccatcgcactcgctgtcggtgaggcatccatccgcgacgaggactatttccagcagacctgccgcaaggtcagcaccacccgcgaccgctcggcggaggcgctgcgggcgcttggttttaccgtgctgccgtcgctgacaaacttcctgtttgtcacccatccgaacaagaaagcgccggatatcttcgccgccctgcgcgaaaagggtatctttatccgctatttcaagctgccgcgcattgataattacctgcgtatcaccgtcggcacggatgagcagatggataagctgattgcagcattgaaagaaatcctctaaataattgagaattgaaaatggagaatggagaatgaaccttagatggagcattctccattttttcatttatattgtgcaaatttgttggaatttggacacgcattgcgcgtcctttgtttacggtatgcaccggctttcataccaacctgcactatccattcattttccattttccattctcaattttccattctgcacaacgaaaaatccctctcgtttccgagagggattttcctttacctgcttggcgtatcataacttcttgcccgttcgctgtccgcgacacccttagttgtcgggtcattgacggcgttccacacgctcgacagcacaaggaacaggcaatacggattgcgcaccgcattgcagagcagcgcgccgacgctctcccaggtggtgaggtcagcggcggtcagaccggcatacgccagcaccgcggcgaacgcgctcacaacaatctgcatccagaataccggattcctaagccgcaccttccagttcactcgacttcctccttttccaaatcactgatgcggtggttagccacgcggacacgctcgtccagcagcgcgactgcctgctccagcctgaaggttcgggtgatgaggttattgtgcttttcgaccttcttttcaagctgctcgatgcggtaattgaccagcttgccggagacgataatgccgccggccgtgcccgccagcgtccccagcaggctcagtcccgcaatgatgatctcagctgacacgttttcacctccttgcttcgcataagtgcctgcacccatacgccgttcggcggcgaaaattgaccacgaatggtcaactcggtcgaaattttttatttttctttgagcgcaccctttttgatgttcgcctgcagaatgttatccgtcagcttatacaggtacgccgagcctttctccgtgcggctctggcggccgtagacctgcttggcggtcacatcgtggtcggcccagtcgctgccgccgttgctgttgttgagcaggagcggctgcagattgtccatcgcgtgggcaaagtgcgcctcggcggtctcgtcggcctcaaattcgtcaaaaacagccatcagcccgcgtttctggtcgtccggcaggagcgaataaatgcgctgctttgccgcgtcctcgcgtgccttctgcgtcttcagaccgtcggcgtcgtaggcgtaggtgtcgcctgcgtcaatctccaccacatcgtgcagcaggcacatgagcatgacgcgcgccacatccaccggctcgttggaatattcctgcagcagatacgccatgacagccatgtgccatgcgtgctcggcgtcgttctcgcggcggccgtggccggagagatgcgtctgccggaaaatgttcttctccttgtcgatctcgagaatgaaattcagctgtttctgcagccgttcgtccataaatccatcttcctttcgatatgaaaaaacgggtacagcctgcgccatacccgccgaattatttatctttgaggagcgtgttcagctcttccataaaggtgttgatgtccttaaactggcggtagaccgaggcaaaccgcacatacgcgacctcatcaaccttacgcagctgctccatgacaagctcaccgatgaccttgctggagacctcgctttcgagcgagccgaacagcttctgctcgacgtgatcgacgatctgttccagctgcatcagcgaaaccgggcgtttctcgcacgccttcaccagaccgttgagcagcttctggcggtcgtacgcctgccgggtgccatcgcgcttgatcagcataagcggcatgcgctccaccgtctcgtaggtggtaaagcgttttccgcagtggagacattcacgccggcgacggatgctggtaccctcgtccgtcggacgggagtccacgaccttgctgtcttcaaagctgcaaaatgggcacttcatcctacttcccccttgtgaacaccgcttgacgcgcgtggtttgttatctgtctgctgttattatactacgcggggtgctgttaagtcaattttttattgtgataaagcggcaccttttcctgccctgccctccgggcggctccttttctgcaccgacccagcggggtgctcgaactgccgcaggcgggttcgtattccccgctcccctgcgccgataaacagacgcaaaaaaaggcacccgaacgggtgccttttcgatagtcgttagatcttgcggcggcggcggaacttcttacggaagaagccccacagaccggtagacagcataacggacgaccagccgccggccaggataccgacgatcagcggcagggtgaactgcttgagcgacggaacaccgaggatgtataccatgccgatggtgaacagcgtggtaagcgtggtgttgatggtgcggcccatggtctgccagatgctcttctcgccgatgacctcaaacggctccttgcgcgcggtgcgcaggttctcacgaacgcggtcgaatacgatgatggacgcgttgatcgagtagccgaggatggtcagtgcagcagcgataaagttgctgtcgagcggaatctgcagcagaacgtaaacgctcagcataacgagcaggtcgtgaaccaggcagcagatcgcagccaggccactggtcagctcgaagcggaaggtgatgtacaccagcatcagcaggattgcaagaatcgagcagaggaatgccgaacgctgcaggtcgctgccgacagaagcggatacgtcattgttgttgaggatatcggtatcggcaaggctgtacttctccagcatcttgtcgatcacggcagcacgctgctcggaatcgatcgaggtggagcggatcagcacgtcctcgttgccgtcaccggaggaggttacagaggatgcatccacaccggttgcgtccttgaacagatcgctgacttcggtctggatatcctgcgtaacagcggtatgcatgttgaactccatctcggtaccgccggcaaagtcgatgctcaggttgaacaggttcttgccgaacggcagcaggatcagcgcaacaaggccggttacgatcagtacgacagagataccgctgaagatcttgaagttcttgaggatcgggaaatgcttcttctcttccttgcgctcgcgcaggccgtaagccttcggattgcggatgtggaaatccaccatgcgtctgagcaggaagtgcgtgatggtcagcgcggtgaacatggacacgataacaccgatgcccagcgtggtagcgaagccgacgatcgtgccggtgccaaggaagaacagcacgccgcacgcgatcagggtggtgatgttggagtccagaattgcggtgaacgcacgcttgaagccggagtcaatggcgctcttgacggtcttgccggcagccatttcctccttgatgcgctcgaagataatgacgtttgcgtcaaccgccataccgatggacaggatgatacctgcaatgcccggcagggacaggtttacgcggatcaggctgaacagcagcgcctcgataaccatgtagaagcacagagcgaagcaggaaacaacgcccggaatgcggtacatgatgatcatgaacagcataacgagtaccagaccgatcaggcctgccttcaggctggagctcatcgcgtcagcgccgagctgcgggccgacagagcgaagctctacctgcttgagcgagaacgggatctgacctgcgttgatgaggtttgccagctcggtcgcgctgtcgcgggtgaagttgccggtgataacacagctgtcgttgtcgatcttctcggaaacagacggatacgagatgatctggttatccatcatgatgtacagaatgttggtgccgtccgtgcgggcagcaacggagccggtcgcctcagcgaacttcttctggccctcggaggtgaactgcacttcaacgtagtgctgatcggacatgccgttcgtcgggttgccgtagccgtaggacgccttcttgatatccgagccggacagccactccttaccatcggcatcgaggaaggtcagctgagcggtggtgcccagggtctgaaccgcttcctccgggttggtgatctgcgggatttcgaccgttacgcggttgtcgccgctgagggatacggtagcctcggtaaagcccttgtcggtcagacgctgacgaatgaccttctgtaccgagttcatgtcgtcggacaggttgttggtgtcgtagccgtccgggatttcggcctcgtatacgatacgggagccgccgaccagatccagacccagacggataccgttgtcggtatcgagtacgctcgggatgatggccttcagaccggagtctgtcgtgtctgcggaatcggtcgaagccgagtcagcagaggtgttagcagacgcatccgtgctgtctgccgttttgtccgccttgtctgcgctgctgtcggtagacgaggtatcgctcgtatccgtcgcagacgtgtcggacgttgccgtgttccggaacggcatggtccagccgcccggaatgtacactcctgttaccgccgtcacgccgaagaaaatgatgatcagcatgaccgcgataaaggaagttacactctttttcacttgcaagtgcctcctttaatttttttgttacacaactgatttagtatacagcataatagccaaaaagtcaatcattctgcatgaattgtgcaacatttatgcgccattgacgcataagcggcagaatatcccgcgtgagcgggatatctgtcaatttcagggataaactttccggtttacaggttaatctcaacctttacatcttcgccagtcagataaggtgcaatggcaggacgaacacactcgttcaggaactcgtctacctgagacgggcagcggccgatgtaagcggacgggtcgaggtgctcgaggatctgctcacgggtcatgccgaacatcgggtcgccggcaatgcggtcaaccatatcgttctcgaggccctcctccttgatgcgcttgccagcagccatggagtgctcgcggatgcgctcgtgcaggtcctgacggttgccgccgcgctttacggcgtccatcatgatgttctcggttgccatgaacggcagctcgttcataacgtgcgcctcgatgaccttcgggtaaacgaccagaccggaaacgacgttgatcatgatgttgaggattgcgtcaacggcaaggaatgcctccggcacggaaatgcgcttgttcgcagagtcgtcgagcgtgcgctcgaaccactgggtagccgaggtgaacgccgggttcaggctgtcgcagatgacgtagcgcgccagtgcgcagatacgctcggagcgcatcggattgcgcttgtacggcatagcggacgagccgatctggttcttctcgaacggctcctctacttccttcaggtgctgcagcagacgcaggtcggttgcgaacttggaagcggattctgcgataccggcgagcgttgcgagcgtctgcgcgtcgatcttgcgggagtaggtctggccggagaccggaaccacgcctgcaaagccgaaatcatcggcaatgcgcttctccagctccttaaccttgctctcgtcgccgtcaaacagctccatgaaggacgcctgcgtgccggtcgtgcccttgctgccgagcatgcgcaggttttcgatgcggtattctacctcattcaaatccatcagcagctcgttcatccacagggtagcgcgcttgccgacggtggtcaactgtgcgggctggaagtgggtgaagccgagagtcggctgggacttgtgcgcatccgcgaactgcgccagcttgtccagtacggtcgccagctttttgcgaaccagcagcagaccctcgcggatctggatgatgtcggtattgtcgccgacatacgcgctggtagcgccgaggtggataatgccggccgccttgggagccgccttgccgaaggtgtaaacgtgcgccataacgtcatggcgtacctccttctcgcgctgacgggccacatcgtagtcgatgtcggtcaggtgcgcggccatctcgtccacctgctcctgcgtgatcggcagaccgagcgcccgctccgccttagccagcgacagccacagccgacgccaggtggagaacttcatatccgaggagaaggtgtagagcatctccttggaagcgtagcgcgaagaaagcgggctttcgtacacgttgttcatgttattcgtcctttccggtgtgtattttatccaaattataacgaaataacggacttggatggtgtctaatcttccataacagtccgattttagtttaacactttgcaccggtcatttcaagcaaaaccgaccggttttgcgctatcttgtagcaataaacaaagtttgcagcggtttcgccgttagattttgcgtcctcccctttttcctgcaccgactgaccggggtgcgcgaactgcgttagcgggttcgccctgacggggcggctctttttttcctgcaccggctgaccggggtgcgcgaactgcgttagcgtgttcgccctaacggggcggctctttttcctgcaccggctgaccggggcgcgcgaactgcgtgagcgtgttcgccctgacggggcggctccttttctgcatcggctgaccggggcacgcgaactgcgttagcgtgttcgcccctaacgggcggctcttttttctgcaccggctgaccggggcacacgaactgcgttagcgtgttcgcccctaacgggcggagagtttttcgctgaacctcagcggagggattcgccgtctgcggacggcgggaacgtcgcggcgcccgccgcgggggcaaaaaggaagggacacctgcggtttcccttcctctttgaactcctacctttcccttgcttcctaatccggcgcagatttcctatatgtgaccgctccgaaacaggggaacggcagaggattttttcttccgtgtttttcgcaacctgttcgcagggtcagataccgttctgctacacatgtgattaaatcaacgcaggcgcaacatgaccgtgttgcgcaattcgtgagcgcgttgtcatagacagcacctgcgaagataaatgctactaaatagatagattcgcaggtgccgtctgtaaactccagactaacgagttgcgcggcactgctatgccgcgctctgcgcagagtaaaccatctgtgtagcagaaatgtatccggcactgcgaacaggttgcgaaagacgcggtagaaaaaatcctctgccgttcccctattttcgaagcggtcgccggtctccggtctgcgccagactaagaaataaaaggaagtgggagttaagagggtagaaaccttggtgtctaccctcttgccccgccgcggggcgcggcgaatccccgcgctccgcagagcgcaactccccgctgaggttcagcgaaaaaactctccgcccgttaggggcgaacccgcctgcggcagttcgagtaccccacccagccggtgctgaaaaaaactgccgcccggaaagggcgaaccgcctgcgcggttcaagtgccccagagagtcggtgcagaaaacaaaagaacagcacccttttcagagtgctgctcagaattacgaatgcttacgcgttcttaataaacgcctcaaggcggtcgagacccttgtcaatctcggtgagcgaggtcgcatagctccagcggacgaagcccggcgcggcaaatgcggtgcacggaacggtcgcaaccagacccttctcaaggaacagctgcgcgaagtcctcggcgctctcgatgaccttgccgtacatggtcttgccgaggaagcccttcatgttcatcataacatagaacgcgccctccggcttgatgcaggaaacgccctcgatcttgttcatgcgctctaccagatggtcgcggcgctgctcgaacgcctgcttcatcacctgcatatcctcctgcgggccggtcagtgcagtgatagccgcctgctgggaaatggtggacggtgcagaggtggagtggctcaggtagttcgccattaccttggccagctgcggattggacgcgctgtagccgatacgccagccggtcatcgcgtagctcttggacacgccgttgaccagaatggtgcgctccttcacgtcctcgcccagagaagcgaacgatacgaactcattgttatcatatacaaggttgcagtaaatctcatccgcgataacgtagatgttatggcggcagcaaacctcagcgatcgcctccagctcggccttggtgtataccatgccggtcgggttggacggagagttcagcatgaacaccttggtcttgtcggtgatggcggcgtccagctgctctgcggtgatcttgaagtccgcctcctcggttgcagctacgatgaccgggattgcccctgcctgctttaccatctcggagtagcttacccagtacggagccgcgataacgacctcatcgcccgggttgcacagcgtcatcagcgcgatatagaccgagtgctttgcacccgaagccacaacgatctgcgtcggctcgtagtccagaccgcagtcctccttcagacggtagcaggctgccttgcgcaggtccatcagaccggctgccggcgtgtacttggtctggttgttctcaatggcctcgataccggcctgcttgatgtgctccggcgtcggaaaatccggctcaccggcaccaaagccgacaacgtccttgccctctgccttcatctgcttgaacagcgaatcaatggccagcgtcgtggacgcctgcacaccttctgcaatcttggaaatcggcttcaatgccatgctcagcactcccttatatctctcatcagttatcatgtgcttttattatatgcctgcgaatttatttttgcaagtcctgacttaacaaactgcaaaatcgacacaatagaaaaacccgccgatattggcgggtcaggtgtggaattttcacaaaacacggtcgcgtgagaagataatcagagccgttccccgttcaatcgtgacggcaaagcggctgttcggttttgcctcgttcgaggtggagatcatgccgacacgggtaaccgtgccgttcgttaattcatattttgcattctcgatggtcacgcccttgagcaccgcgtccatcggcacgaccgagaagtaggtaaacgtctccggcatgatgaattcctgccgtccgccctgatgcagctcaacgcggttgtacggatcgaggatggtcaggtggccgccgagcgtttttgcttcctcgagcagcgagagatttgccagcatatggtcgatgcgcccgccggtcgcacacacgagcgtcgcctcgcggcagccgcggcggaacacctcccgcagacagctctgcgaatccgtgtcgtccttctcaggtctcagcaggatcacatcgtcgccctctacctcggtcatggaatcccggtcggagatcatgaaatccggatgcagaccgagcgcccgcgcatgccgcaggccgccgtccgcacacgcaacgagcgcgtccggatgctcgcgcagaaacgcgcggatgtaaccgtaatcggtttccggtgcagccgcaaaaatcagcgcgtgccgcccttggtaagttcccattccttcagatcctttacactttcatacagctttacatagctttcgtgacgggttttcgcaatttctccgttctcgaccgccgcgagaacggcgcagcccttctccttgacatgcgcgcagccggtgaatttgcactgcccgatgtacggctcgaactccggaaacgcatactgcagatcctcggcaagaaccaaatccatctgctcggtctcaaacgaggagaagccgggcgtgtccgcaatgtagccgccgccttcgatcggatgcagctccacatgacgggtggtatgcttgccgcggccgatcttgtccgaaatcgcaccgacctcagcgccgaacgagctgtccagacggttgagcacgctcgacttgccgacacccgagttacccgcaaacgcgctcaccctgccgcggatgcgttcgcgcagtgcgtcaatgccctcgccggtgtgcgcgctcacgcgcagcacctcgatgccgcttctgcggtaggtttcatacagctcgtcgcccggattcgcgtccgtcttgttgatgacgaccagcgcgtccatatttttgtgcaccgcgatggccgtcatcttgtcaatgaggaacgggtcggtcaccggcggtgccgcgctcgccacggcaacgaccagatccagattcgccacagccggccggatcaggctgttcttgcgcggcgcgatcgtctgcagatagccggtgccgtcctccggttggatttccaacgttacccggtccccgacgatgggcttgcccacggtcttgcggaaccgcccgcgtgctttgcattcaatgagaccctcggcggtatccacatagtagaaaccgccgatgcccttcagaatgatcccttcgatcaaacttaattcctccgttttttaactgaatgtgtacgtctgcgaggtagtcgaaccgtccacgctgaccgtaacatcatggtcgcccaccgagccgctcaccgagatggacgtgctgccgccgctcgtgctgcaggtgtcgtcatactggatcacgccgtccacatagatgataacatgcgcggtatccgtgttgtccggcagcgaaaccggaatggtcgcactgccgaggctcggcgtatcatcgtagtcgccatcaccgttgtcctgaccgccggaattgccgccgctgttatccggcgagttattgttcgatgtgctcttgcccttggagatctggatgttgaccgtgctgcccttggtcacctcagcaccggcatcctgcgactgccatacgaccgaccccgcttccgcagagctgtccaccggatctaccgagccgatcttcaagccctttgcctccagcgccgcacgcgcttggtcctcggtcatgccgagcagaccgggcacagcgacattttcgttatcgtccttctgcttgcccttgctgatatagacggtcagcgtcgcgcccttttccagctcggtgcccgcctccgggtcggtgcggatgaccttgccttcctccacgtcgtcgctgtattcctcaacgacctcgcacttgatgtcgtgcgatgccagcgccgcctgcacataatcgagcgtcttgccggtaaagtcgatcaccttgtaggtatccttgacgttttcgccgcccgaggataccgttaccgtgatgatcgtacccttggttgcctttttcttgccgtcgccgtccgggtcctgctcgagtatctcaccgaccggacggtcggattcctgccgttcggtcgcttcctttaccgtgaagttgtcggttatatccgggtcggccatcacttcgtcgatattgcgcccgatgaggtcgggcacgataatcttctccgacttgtcgctgctgccggtgatcatcagaatgccgaccagcagcagactgatcaccgcaatcacgccaaccgccatgccgaccgccatcccgggccgctcggccagcttttcaaaaaagccgtccggctcatcctgctccttcctgcggaaaccggtgcgggtgcggggctgggtctgcgtgcgcgtgcgcgtgcgggtgcgcggcgcagctgcgccctcaacggaagcggcttcatgctctgccgcactgcggcgcgccgcacgctgaatgtccgcgccgatgatctgcgtctcgcccgagttgtcctcgcttgccacatagtggaagcgtgcattcgggtccgagcggagcacctccatgtcctcgtacatcttttccgcggattcataccggcggctgatgtgcgcactcatggcgtgcatgacaatatcgtccatgcccttggggatgcccggcacaaacgcactcgggatgatcggcacctcattgatgtgctgcatgacgatctggagcgcggtttcgccctcaaacggcagcttgccggtcagcatttcgtacatcatcacgccgagcgagtacaggtcggtgcggtaatcaatcttgctgcccttggcctgctccggcgagatatagtgcaccgagccgatggcctcctgtaccacgcgggtctcctgcgcggcagcgaacgaggcaatgccgaaatcggtcagctttgccgtaccgtcccgcaggatgataacgttctgcggcttaacgtcctgatggatgatgccgcgcgagtgtgcgtgcatgagtgcgcgggcaacctgttcagcgaagaaaatggtctcctcccacgacagatggcccttgcgctgcagatactgcttgagggtgatgccctcgatcagctccataacgatataatccgtgccgtcctcgctgccgacgtcgaacacggaaacaatattgtggtggctcagcttggcaacggcgcgcgactcaatggagaaccgcttgcggatatccgggtcctccgcgaactcttttttgagcaccttgagtgccacatcgcgcccgagaatggtatcccgcgcccgataaacgaccgccatgccgccgacgccgatgatttcctcaatctgatagcgtccgccgagcatactgccgatatatttatccatagtccgtcacgctccctgctttttaccgagggtgaacagcgcaacggtgatgttgtcgcggccgccgccgtcaagcgccagctgcagcagcgcgtcaccggccagctcgagcgtcggcgcgtttgccagcacctccgcgatccggctgtcctccgccatgccggtcagaccgtccgagcagagcagcagcatgtccttttcgttcaggcgcacttcaaacaggtcgccttcgacacacggctccacgcctaccgcacgggtgatgaggtttttctgcggatgggtgcgcgcatccgcctcggtgatcttgccgcggcggcgcatttcctccacataggagtggtcctcgctgatctggtgcatggctgcgccgtcaaagcggtacgcgcggctgtcgcccacgttgatgacggtcgcgcagtcgccctgaatgagcgcggcaaccagggtcgtgcccatgccgcggaactccggctgcctgcccgccagagagaaaaccgtctcgttcgcctgcttgagcgcctgcgtcagcaggttctgccgagccgtttcgtccagcgtgccgcttaaagcgtcacccgcggactcgataaagctctgcgcggcaaagcggctggctacgttgcccgcatttgcaccgcccatgccgtcgcacacgacgaggagcgcggtctggttgtcctcccgcgcttcgatctgaaaaatatcctgattggtcgggcgcacccgtcccttatcggtcaagccgaaatattccatttcacaacctccttcgattgtgtctatttcatgctgagatattaaggcaacaccgcacaattaaagcggcggtgccttaagtttatgcacgagatgtgctctttccgtcctccttcagctgccgctgacggagctgaccgcaggccgcatcaatatccggacccagcttgcgccgcacggtcgcggtaacgccgcgcttctcgagcgcctgctggaacctgcggacggtttccggtctggacggcttcagcggactttccgccacctcattcagcggaatgaggttgacgtgcgccggacgtcctttcagcagcttggccagaaggtcggcctgccacgggcggtcggtcttgtcgcgtgccatcatgtactcgtaggaaatgcgccgtccggtggtgtcgaaatagtaccggcacgccttcatcaggcgctcgaccggatatgcgtcgttcaccggcatgatggacgagcgtgtttcgtcatccggcgcgtgcagcgatacggacagcgtgatctgcagcttttcccgtgctaacatctctattctatcagcaattccgctggttgacaaggagatatggcgctgtccgatattgattccctccgggcagctcaccagatgcaggaacttgagcacgttgtcgtagttgtcgagcggctcgccggtgcccatcagcacaatgttggagaccttttcgccgctgtccttctgcatgaacaggatttcatccagaatctcgcctgcggacagactgcgcgtgcgtccgttgagtcccgacgcgcagaacttgcagcccatccggcagccgacctgcgtcgaaacgcagacggacacgccgtgctcgtagtgcatcagtacggactccacgcagttgccgtcccgcagacgccataagtatttcaccgtgccgtcaacgcggctcacctgcttgcgggctacttccggtacggtcagcaggaaattttccgctaaacgcgcccgtaagtccttggataagttggacatctcttcaaaggactccacaccctcgtgaagccatttgaagatctgtcccgcacggaacggcttttcgcccatctctttcagggcagcctttaattcttctattgataatgatttaatttcagtcattattttcacctttgaattgagaatggagaatggagaattgagaattgcggtatcgcgctgtgcgcgatgattgaataacggcgcattgcgccgcacattcattttccattttccattctcaattttccattattaaacttccggtgcattttcgcaataaagaatccatccgtattgtgaacgggcggcagcagcgtcaccataccgtctgccctctctccgcagaccggatgcgtccacgaaaccgcttcaaactccgggttttcggtgagaaacgcgcggacaacgtcctcgttttcccgctgcaggatggtacaggtcgagtagacgagcgtgccgcccttctttacatactgtgcacagtttgcaaggattttcgcctgaatctccggcaaagtccggatttcgtccggattcttgaaccggatttcgggtttcttgcggataatgcccagtcccgagcagggcacgtcgcacagcacaacgtccgcgctgtccttccactcctcgcggcagaccgatgcgtcctgcagctcggtgcggatattcggcagtccgaggcgggctgcgccgtcgcggatgcgcttcagcttgtgctcgtaaatatcgcacgaggtgacgctgcccttgccctgcattttttcagccatggcaaagctcttgccgccgggcgccgcgcagcagtcgagcacggtgctgcccggtttcgggtcagcgaccgccgccgcgagtgcgcttgccgcgtcctgcacggtcacgcggccctcgataaacgccggaagcgcggctgcgtctccgccgctgcacagcaggatttccgggaatgcctcgtgcggctgcacggtcagtccggcggcctccagctctgcctgagcctcggcaggcgtgcatttcatcgtgttcacgcgcaccgaaatcggcgcgtccgcgttatccgcctgacagattttctgcgtcagcttctggccgtactgctcggaaagcaggcgcacgagccactccgggtggctgtactgcagcgcgtagtagctttccttgtccgggcagttcaggcgcggcaaagaaccgttttgagccgcatttgcggcatttctcagcaccgcattggcaaaggcgaccgtgcggtcatttgcgtggccgtagtgcttgaccagcgcgaccgtctcggcgacagcggcatgcgccggtatcttgtccatcaggatgagctggtaaaggcccatccgcaggcacgccagcacacgcggcgcgatctttttcagccgcacgctcgagaagtgccgcaggtaccagtccagtaaaatttggttctgcaccgtgccgtaggtcagccgcgaggccagcgccgcatcgcggctgtccagtcccgcgcgggataaatagtggtgcagcgcaccgtccgaccaggcgtcctcctctgccatggaaaacagcgagaatgccgccacctcacgcggtgttttggggcgtttatctatcattgcgatctcttcctccaaaaatcagcaccagacgcagcagctgtgccagcgaagtcgccagcgcggcaacataggtcagcgctgccgctgtgagcgtctttttcgccatcgggtactcgtctgcggtcagcaggccgttctgctgaatggtctgcagggcgcggcgggatgcgtccagctccaccggcagggtcaccagctggaacagcgtggacagaccgaacgccgcaatgccgatcgtgacgagcgtgctcgtgttaaggatcaggccgaggatcagcagcggcatcgccgccatcgagccgaactgcgtcagcgggatgatcgccgcgcgcagcttgatcggcgcatagccgatggcgtactgcaccgcatgccctgcctcgtgcgcggcaacgccgatggacgccaccgacgtggacgagtacaccgcactcgacagccgaatgacgttgcttctcgggtcaaaatggtcggtcagcttgccggaaacgtactcgatccgcacaccggaaacgccgttgtaccgcaggacagcctccgccgcctgtgcgccggtcagtccccgcagattttgcacccgcgagtagcggttaaacgtgctgtttaccttgttctgcgcccagaatgcaaataaaacgcacggcagaaccagtacgatgtagtacatgtcaatgccgtaatatccatagtaaggcattaaaaaccctccaattcagagtggagattggagagtgcagagtgaagattacgttctcttcactctacactcttcactctctttattactctcccagcttcacgccaacttccagactgtgtcctctgagaaagtccgtcgctttcatgcgcttgccgccgacgagctggatttccgtgagccgcagggcaccctctccgcacgccacggtcagcccctttttcgggtcggcttcgagcaccgtgcccggctcgccattgccggctgccttttcggcggcaaacaccttcaggcgctcgcccgcaaggctggtcagcgcgatgggccacggattcaggcctcggatcaggcagtcgatttcatgtgcggacttgctccagtcgatcaccgccatctgcttatccagcatgtgggcgtagcagctctgcgcatcgtcctgcgggcgcggcgtgatctcatctaatttgacgagcgtttgggtcaaaagttctgcaccggactgtgccagacggtcaaaaagttcgcctgcggtctccttctcaccgaccttggtctcataggtgagcagcatatcgccggtgtccagaccctccgccatctgcatggtggtaacgcctgccatttcatcgcccgcgatgaccgcccactggatcggagcggcgccgcgccagcgcggcagcagcgaaccgtgcacgttgatgcagccgtgcggcgggatatcgagcaccgccttgggcagcagcttgccgtatgccactacgatgataacctcgggtgccagctcgcgcagacgcgcctgctcgtcctcatttttgagggtattcggctggaaaaccggaatatcatgctcgagtgcgagcgttttcaccggcggtgcagtgagaatctgcttgcggccctgcggcttatccggctgggtgtacacggcgcagacgtcatgtccggcgtcgatgagcgcctgcaggctcggcacggcgaagtccggcgtgcccatgaatacgatacgcattattcctcgtcaccaccctgcattgcctccgggtcgatatactcctcaaccttctcggtgaacagatggccgtccagatgctcggtctcgtggcagaagcactgcgctacaatgccctcgccttcgcgctcgaaccagttgccaaaacggtcctgtgcgcgaatcttcgcccaggtcggacgggtcacatagccgtaaacgcccggcacagacaggcagccctcgacaacgcgctcggagcctttctgctcgataacttccgggtttaccagctcgaccatctcctccggctccttgttcacatccagcagcacaacaacgcggcgcaggattcccacctgcggtgctgccagaccaacgccgccggagttctcgagcgtctcacgcatatcgtcgatcagcgtatgcagacggtcgtcaaacttctctaccttgcggctgtgcttgagcagctgctcgtcgccctcggtcaaaatctttctcagtgccattgttttattcctccacttgattcagcttatccatgtatttttgtaaacattcctgtatatttttctcatcgagcgccggaaacggcgtcaccggctgcggttttccgctgccgatatgcttttccagccatgccacatcgtgccagccgtcaaacttccagccggagtcgtgccacacgcctgcgtcctcgaaaccgagttttctctgcatgcggatgctcttttcgttcggcagggtcacgcagctgtacaggtggcgcagcccctgcagctcgagcaggtcgatcaggcacgccagcacggtcgtgcccacaccatgtccgtgggtaccctgtgccagatagatggacagctccgcatcccagtcgtaggccgcgcgttcgcggatgcggtgcgcgtaggcgtaacccatgatagcgccgtcctgctcgcagacgagatacggaaacgcagccgccgtttcgcggatacggtccgcaaatgcttcagccgtcggcacatcatattcaaacgtgatggttgtattcgttatgtaaggctcgtaaatcttcaaaagcgattctgcatcgttttctgttgccttgcgaattacaaatttgctcattgaattaaccttctttgccggtgtctcaattactgctacatttcattattggaatccgcgaacacggtaacgccccggtttttaccatcctgcataaactcccgcagcacgcccgagatgagcctgcgccatcttgcacaatcctttgcacggatggtaaggtggtagcgataccgtcccatcaccttgaccatctgcgccgcggcggggccgagcacgggggctttcacatcggcaaactgcccttccatcaggctctgcaggcgcgttttgagcgcgagcagactgctgagcacctgctgctccagttcaccgacggcggttatcatggtgatgtcgcacacgggcgggcaccgaagcgcttcgcgcgtctgcatttcgctctcgtagaatgcctcgtagtcctgccgcgcggcggtcaggatgaccggatgcagcgggctgtacgtctggatcacggcgcgtccggtgtcaaatcgccgtccggcgcggccgaccacctgcgtgatgagcgaaaacgtgcgctcatgtgcgcggtagtcctgcgcgtacaggctctggtccgcgtctagcacgccgaccagcgtgacgttctcaaaatccagtcccttggtcaccatctgggtgccgataaggatatcggcttcgcctttgccgaatttattcagcaggcgttcgtgtgcgcccttggcagtcatggtgtccgcgtccatgcggagcacccgtgcggacgggaaccgctcatgcagctcctcctccaacttctgcgtgccgggcgtttcggtgaacaggctcgtgctgccgcactgcgggcacttgccggttatcttgatggaagcgccgcagtagtggcacatcgcgcggccggacaccgaatggtaggtcatagtggtcgagcaggacgggcactcgggcacccagccgcacacgccgcagccgatcacgcggctgttgccgcgccggttgaggaacaggatggcctgctttcccttttcgagcgtgccgatcagttcgcgttccaaatccggcccgatgatgccgctccgtccctcacgggccagtccgcgcatatccgagatgatgacctcgggcagtccggcaccgagaaaccgctctgtgagcgcgaaaaccgggtattttccctgttttgcgccgtaatacgtctcgaccgacggcgttgccgagccgagcacgagcagcgcgttcgtctgcgccgcgcggtactttgccacatcccgcgcatggtagcgcggcgactgctccgagcgatacgccgcgtcctgctcctcgtcgatgatgataacgccgaggttcttcgcgggcgcgaacaccgccgagcgtgtgccgatgaccacccttgctctgccggtttttatcttcttgaagctgtcgtaccgctcaccggcggacagcgccgagtgcagaaccgcgacttcttcgccaaatcgagccgcaaactgccgcagaagctgcggtgtcagtccaatttcgggcacgagcacaatggcgctctttccctgctccagcgcgtgcgcgatgagctggagatacacctgcgtcttgccgctgccggtcacgccgaacagcagcgccgcatgaggcgcgttttcgtccatgagcgccgccatgccgtcatacgcctgctgctgcgccgccgaaagcaccggggccgcggcgcgcggcacctcggaaaagtccggtgcgcgcagcacttcctcgtattccgcgcggaggatgccctttttcgtcatgtcgcgcagcgcggcgtcgctcacgccggtcatgtagacgatttccttctggctcatcgcaccgccgtccgacagcagcgacaccacgtccatccgcgccggactgcggcggctgatgtgcgacatggcttcacttgcttccatatccaaacggagcattttttcggtcttatcaccggttttctgcgccgtattgctgtgataaacgagtatcccctcgcctgccagcgcgtccagcgtctgtcccgcgcctttgccgagccgatcgcgtatctcgctcaccgagagcgtctgtcccggctgctcaaacagcgccagcacctgaccgtcttcgccgtcccgctcccgcagagccgccaaatccgcgtccggcgcgagcgtgtacgtctcgtttcgcttgaaccacaagccggcgggcagcatggcgtgtacgcagtcgaagtaggtgcagtacaatctctcccgcatccacgccgcaagtctcagctgctcagcggtcagaatcggcgtttcgtccagcacctccacgatgggcttgagtttgaactcgcccgcatcctcgcggaaggcgagcaccaccgcttccgcccgtttattgccaaagccgaacggcacgagaacacgggtgccgatctgcacctgttcccgcagctcgtccggcacacggtaagaatatagcttgtcgatggcataggttgccgcatccacggcggccgcacagattttttccgccatagaatcacaacctttcgcttcttcttttatcgtcgcttgcagtttatcgtagggcgcgacaaggtgaattgcggcaacgccgcaagagaaggtgccctggggtacgactcggcgcgccgctgtcaatcggtgcataccgttccatacggcgtgccggggtcgtcacgccctacggcattgttttcatcggttacggataaacagaaaccatgacgttaattttccattctccattttcaattctcaattactcatcgcgagaagtctatcgagaatcaggtcagcaagtgcttccttgctcatcatcggcggggtttcccgatggccgtccttgaagagcagcgttgccacattggtatccgtgccgaagcccgcacccttatcgcgcagcgaattcgctacaagcatatcgcagttcttgcggcgcagcttgctctcggcgttatcgagaaggttctgcgtctccatcgcaaagccgcacagcagctgtcccggctttttgtccttgccgagcgcggcgaggatatccggattgcgggtcagctcgatattcatctcgccgtcaccctttttgagcttttcatccgcagtctgcgccggacggtaatcaccgacggcggcagccttgatgatgaaatcctgctcgggtgcgcggctcgtcaccgcgtcgtacatatcccgcgcggaaacaatatccacgcgcgtgacaccgtgcggcgtatcgagcgcggtcggtccggaaacgagcgttgcgtcagcgccgcgcatggccgcgcgggccgcaatcgcgtaacccattttgccagtggagtggttggacaggaaccgaaccgggtccatggcctcctgtgtcgggccggcggtaacaagaacgtgcctgcctgccagatcctgctcggtcagcgccttttcaatgccccagaggagcgtgggcgtgtccggcagcttgccgcgtccgctgtcgccgcaggcgaggtggcctgcgtccggctcgatgatgtggaagccgcgctttctcagcgcagcgaggttctcctgcgtcaccggattgtcatacataccggtgttcatggcgggagcgacaacgaccggtgccttggtggcaagcagcgtggtcgtcaccatgtcgtccgcgatgccgtgcgccgccttggcgatgacgttggctgtcgccggtgcgataacgaacacgtcagccgccttcgcgagcgaaatgtgctccacctcccacggaaagctgcggtcgaacgtatccacgaccgcgcggttgccggacagtgtttcaaacgtcatcggcgcgataaactgggtcgcggactcggtcatcagcacatggacagtcgcgccgttctggtgcagcttgctggtgagatcggcagctttataggccgcaatgccgcccgtcacgcacagaacgaccgttttccctgcaaaacgcatggcttagaggtcctcctccggaatgtcaccgtcgctcagagagccgtcgtcaaactcgttcaggcggcgcacctcgtccgcattctcatccttgtcctcgtcagcctcggagtcggtgtgctcctcgtcctcatccagatcaagggtgtcgtccacgtcaaccatagcggctgcaatggcattgttctgcggaatggcagtctccacacgcggacccggacggtaaacgatcttgccggctgcgatctcatcgagcgccagcttaacagccttgtccggcagcggctcgcccttttcctctgcctcatcggcaatatcgcgggcacgctgcgctgccaggtttaccagcagatagcggttgcctactcgtttcatcagttcctgcatagaagggttcagcatagtaatcagttctccttatttaccagatatagttttattttatgaaagtttctgtttatatgatgtcgcttatcgacgcttggcgagaatgccgtgcaattcttcaaccgcacgctccaccgtgtcgtttacgacgacgtaatcgaatttatcctgctgggcaagctcgcccttcgccgtttccagacgcttctgcaccttggcttcgtcctcggtgccgcgtccgcgcagacggttcgcgagttcctcgaacgacggcggcgcaatgaacaccatcactgcatccggacgcttttcatgcacctgcatcgcgccctgcacctcgatctcgaggataacatcatagccggcctccagcttttcgttcaccggagcctccagcgtgccgtagtagttatcaacgtacttcgcgtgctcgaggaacgcattggcggcgatcttcgcctcaaagtcctctttcgtgaggaaataatactgtacgccgtccttttcgcccggacgcggcgcacgggtcgtcgcagagatcgagaagaacagcttctcgtcctcgctcagcagcctggacagcactgtgcccttgcctgcaccggacggtccggtgaatacatacaacgttcccttacgcatcttctggttctccttcctcggtctcgcccgcaaaacgagccgcaacggtctccggctgcagagcactgagcaccacatggtcgctgtccatgatgagcacggcgcgggtgcgtctgccgtaggtgccgtccacgaccatgccgcggtcgcgggcctcctgcacggtgcgcttgaccggtgcggattccgggctgacaatggcgatcagccgcgacgaagcgaccatattgccaaatccgatattgatgagcttcatcgctgacctcactcctcgatatactgtaaattactcgatattctgaatctgttcgcggattttttcaatttcgctcttgatattgaccacgatctgcgccatggacacatcgtttgccttggagccgatggtattggtctcgcggttcatttcctgcacaaggaaatccagcttgcggccgaccggcttgacctccttcagcatgccgtccagctgctgcagatggctgcgcagacgcacggtctcctcgtccacggcggtcttgtccgcgtagatggccgcctcggtgacgatgcgggtctcatcgatggacgtatccgccagcacctccttcatgcgggcaagcagcttctcgcggtactcgcgcacgcgctccggcgagcggacctccacctcaccgaccatgcgctcgatctcggacgcgcggtttcgcacatcctccgccagctttgcaccctcgcgggtacgcatttcgtcgaaattgtcgcaggcttcgccaaagacggacagcacatcgcgggtcatctcgtccgcgtcctgctcgatgcgctcggagccgagcacgtccggcagcttcgccagactcatcacgctcacgtcgtcgcgcagaccgtacctgtcggccagctcatgcagcgccgccagatagtgctccgcgaccgcatggttcaccgtaaccgcaatgtcgccgccctcctgcgtctccacgccgatgtaaacctcaaccttgccgcgtgcaatgcgcgccgcggcagcctttttcacggcatcatccagaaagccgtactgacgcggagcctttaccgtgcagtccagatagcggtggttgaccgcacgcagttctgctgtgatggttctgccgtgcagctcctgcttggcacgtccgtagccggtcatactcttcatagatatctctttcccttcttattcgggcggcagggtgcggcgcagcagcgcgatcacctttgacaacccgatatcatatacaataaagccgatatttgccgcgatccacagtccggcaagccggaaaatacccggcatctgcacctgcggaaacagaccgcagcttaccagaacggccgcgagcaccagcacaatgttaaaatacgccagcttgccgctcagctgcgtgaaaaccggcagacggcactcgatcagatatttcacgatcgggtacaggccgaacagcagcacataggccgccgcgatcagcttgcgcggtgtcagcagcagtcccagtaccgaggtgacgaggtacagcagcaccgccgttttcacgttcgcgcggcgcagcagcggtatcgctgaggccgcacctgctatcaggcaggccgccggtccgatctgcggcatcacaccgccgaaatacagccacgccgtggccgccgctgccagaagtccgccgcgggcgatctcgcgcgtgctcatatcagcagccgcctcctccgcagcacatgttcaggcagcagttgcagatgagcgtctgcacacagcagtcgcacatgcttgtctcctgcatgggccggtagccgccgtagccgccggacagatggaggttctgcagtgcgtgctggtactccgcgttgttcgggtccatctgacacgcctgcgtgtacgcgcgggcggcctcatcgtaccagcccttgcggtagtataccgtgccggtcagatagaaccactccgcatcccgtcctgcagcacgctgcagcagcgcctccgccatgccgaggttgccctgattgatggcctgccgcacctgactgtacagcgcagcattcgcaccggtgtaggtacgctgctgatagccgccgtactgctgaccgttgtatgcgccgccatagctctgctgctgtccgctgctgcctcccgccggattcctgcgttcgttcatgatcatgtcgtacgcttcgttgatctccttcatgcgggtttcggccaaatctgccagcggattgtttacatagttatccggatgatacttgcgcgccagttcacggtacgcgcgcttgacgtcatcatcacttgtttgcggtgttacaccgagcactttatagggatccatgtttgccccttccttcgtttgtctggtaggtgccgttcagtacctgtcgggtgacggtcggcataccaagaaaaatgatattgcggatcaggtccgcatctctccggggactcagcaggtcaaacgccatgcagatatccgccagtgagcgttcgagcgtgcgctcgagcggttcccttaccgcagagatgtccggcgtttgcagctcgtaccgcagaacgaccggattgtagctgttctcttccatatccttttggatgtcctgcaccgcatcgacaaggtagatccacctgccgatctggtagaacatctggtgcagaatacgctcgcgggtgtctccggtgcgcggcacaacggcagccgtcatgcgcgaggacgtatccgccgcacggtccatggacgggcagcgttccgcctccagacggcgcagatcctcgagcgcctgccggatgtcctcgtccgcttcgggcatgcgtgcgcgcgccttctcatagccgcggcggccgaggcggcacagcagcgccgcaaacgcgcgtttcgcgcccttttcgtccgccaggtcatcctgaaacttgtgataggtcagcaggatactcgcgtccgccgccagacgaagtgcatcgtctgtctcggcgcagcttttccgccgaaacggagaagcgtcgcatcgttttctgcacggcggagcagtctccgcctcctcacttcctgcaacaagtgcaaaaaacgtcatatcgtagcttaaaaacaaggtgtaaaatctgccgtattctgcgcggatcgcgtggcataagccgcagtaaacctgctgaaaacggtcagcctccttcacccgcagctcggccttcaccggacggataaagccaaacatcgcatagccctttcccgccgtgcggtgtgcacggactttcgtattcaatctattttaccgaacttttgcgtatctgacaagggcgaacgcggaaaattggcgaaaattcataaaaaattaaaaggagctgtcgcgaaaccacggtttcgccgacaagaggaacggaccgtgggccgttccaaggtcgtccgaaagttcccatacggaaactttctccctctcaaagtcaaaaatccgtgatacatgctcccggatttttggcatttgcacagcaaatgctattgaatgcgcgctatcgcgcgaaatatcggaagctaatgtccaaattattctctgaattaaagtctttcggtaatggcaaacggcgcttcgtttctgagcttcagcttatggctgtaccacatcgccgccagaatgccgccgacgaacagcacgccgccgatgagcgcggacagtccgccgccaagtttcattcctgcgccgacgccgtagccgacaaaaaacagcacgagcggcagcagatacacgagcacggcaaagccgagcacctgcttcgtctcgccttcgagcagcacgcggtcgccgacggacgcatgcgcgtgattacgtgcggtaacgtaaagcgtctgggtttccagaccgccgcagccgccgcacttggcacagtcatggccgcacgccgagcggcgcgttacctcgacctctgccaggccgttcggcagcagctttttgatggttccctgttgagtcactgtgaaatcttcctctctattattcaaaaccagttgcagtaatggaaaattgagaatgaagaattgaaaatgtcgctctccttgcgcgagttccgtccgcgttgcgacaggttatgcgcaaagcgcatttatttaattccgccctttgggcggcacattcattctccattttccattttcaattctcaatttgcaaactcttccataatccgaaacgccgcgcggataccgtccacggcggcggacatgatgcctccggcgtatccggcgccttcgccgcacggaatgatgccgctgcagccgagtccgaacaggtcctcgccgcgcgtcatgcgcaccggagacgaggtccgcgtttccggaccagtcagcagcgcgtccgctgtgtcgtagccgcgaatcttccggccgaaatacggcaggctgtcccgcagcatggtctgcgcgaagtcaggcaggcaggctgccgcctctcccagctccacgccgatgggatagctgggcttgaccgcaccgagttttcgggtcggcttgccgttcagaaaatccccgaccttctggcacggcgcgcggtacgagccggtctgcgtgtacgccgcgtgctcgatccggcgctgcagcgccacgccgccgaacggcgtgccgtcgtcgtagtccttcgggtcaaccgacacggcaagcgccgcgttggcgtttttgccgtcgcgcgcatgatagctcatgccgttggtgacgaccgtgttctcctcgctctgtgccgcaacgaccacgccgcccgggcacatgcagaaggaatagcacgcgcgtccgtcggctctgcgcgagagattgtactccgcaggcggcagcatgggatgtcccgccgcctttccgtacagagcgcggtcgatctcggtctgcaggtgctcgatgcgcacgcccacagagaacgccttcggctcaaagtacacgccgtttccgtgcagcgcggcaaaagtgtcgcgcgccgagtgaccaatggccagcaccgcccgctcgcaggcgatgtcctgcccgtctgcctcgacggcgcagagcgcaccgtttttgaccgaaacgccggtcagcggcgtgcggaagcgcacttcaccgccgtttttgatgatctcgcggcgcatttcacgaactacattcttgaggatatccgtgccgacgtgcggcttcgcctttttgacgatatccgccggagcaccgtgcgcggcaaggatttccagcacgttgtcgcacagcggatcaccgatgcgcgtggtcagcttgccgtccgagtaggcgccggcgccgccctcaccgaactggatattgcagtcggtatcgagcgcaccgcccttccagaacgcatccacaaccttgtcgcgctcgtccagatctccgccgcgctcgagcacgagcggacggtagccgtgctttgccagcacataggcggcgaacagtcccgcaggaccgagaccgaccaccaccggacggtgctcgagctgcttttcgccgtgcggaatgacgattttcgtattgggtttataacgcacgaagggcatttgcagtttttctgcaaatgccttttcgtcgaacggcgcgtccagacgcaccgaatatacccggctgatctgtccgcgccgcgcgtcaatgctgacgcggcagaccgccgcttgtatgtcgtttgccgtcagaccggtcagccggcgtgcctccgcaatggcggcctgctccggcagatcaaacggcagacggatgccggttaccatcaggctcactggctgccaccgcccttccttgtacggtgcgcggtcggctctgcgaccgtgctgtccatatcgtctgtgctgtctgtcttatccgaggtgatcgtctcatccgacgcatgcgggtcggtgatctcaatctcgacctcgatatcctcctcgacgagcgttacgccgctcggcagaccgacggtcgtagccacgcccttgaccgtgtgcctgccgacgccgagcgataccgaatcgtaggtcagaccgatggacaggttattcacatcgaccttcttcagctggctttcactgccgcgcagctccatctcgaccgacttggtgaggatagcgaccttgtacggcgtattctcctgcgcggtgtcgttccacgcgaacttggagacctgaaccttgcgggtcgcaataccgtccaccgagatggtgacgtttgccgtttccggctgaccgctgacgagcgaaacgccgctcggcagcttatccttgatggacatggagatcggcgtgcccgtgtggacgctgccgaggtcgatctcaccgaggttgatctccttgatgtcgctcagcaccgcctgatcgctcgcgataacctctacgttctccgggttgatgacgcactgtacctgattctgcgtcaggctgccgccgtccttgagggtgacggtcagcggaatgttgttgacgcggtagattggaaccgaaaccttgatcttttcggtctggctggtgatatagttcgaggtgaactccgcaccgtcctgatcatacagggttaccttgcattcgtagtcggccagcgaggaattgcggccggtaacatccacggctgcaactgccttggccacctgcgccagatcggttgccggaccggaaacggtgaccttcttggttgccgtggtcggctttcctgcgcggtagccgtcgtccggtgtgccggtcacattgacctcgaccggaacatccttgctctccacgcggtccacacggacgtgcaccttgccgggattgacatagttggtctccacgccggacttgctgaccgacacggtgaccggaagatcgtattcattcgcctcgatcagacccgagatatccaccgttgcggtgatctggctggcgcggacctcgccgacgctcttgctctgaccgcgcagactgacggtgaccgttgtgttctcgccctcgatgagttccagaccggtcgctgctttcagctgggatgcaccgatgatacgcaccggcacatcgtcaaagcgcatgttgcgctccggattgtcaacatccataacaactgcccacagaacgatagacagcgccagcgacaggatcttcagcagaaaatcctgctttttcagaaaattcttcttcacttgccggcgcctcccttccacttgtcgcggatggcggcaatacggcttttatcgtttttgctcctgagttcatcgccgagcagctcgctctcgagcatcttctgcagaatctcgggcgacagatggcgcttgagcatgccgccgatggcgacagagatcgcgccggtctcctcggagacgacaacgagcacgctgtccgcggtctcgctcatgccgacagccgcgcggtggcgcgtgccgaggtcgcgcgacagaccctgattgccggaaagcggcagcacgcagcctgcagcgcacacccgtccggcacggacgatcatggcgccgtcatgcagcgggctgttcttgaagaaaatgttcttgatcagctcggcagacggtgccgcgtccactctcgtgccggtggcgatgatctcaccgagacgctccttgcgctcgaacacgatgagcgcgccggtcttggtcctggacatatccgcgcatgcggaaacggttgcaacgatcatgctctctaccacatccgggtcggtatccggaatcagcatgcggctgaggttgcccttgccgatctgctcgagcagacggcgcagctccggctgaaaaatgaccacaacggcgaatacgccgacgctgagcgcgttgcgcagcagccacgagatcatggtcagatgcaggaagctggcgaacagcatgataagcaccagaataagaatacccttggccagtcgtgcggcgctggtatccttcagcagcttcataacacggtaaatgatatacgccacgacgaggatatccaccacgtcgatcggcgtcattgtgcggaattgatcaaacgcactgaaaaacgaacttatcatggtccgccatgataaattcggtgagaatacattttgcagcgctcccattttgtcacctatcctaacttgttcctcattttcgcgggcatttgcggatgcacgcagcagattgcacgcaaacaccatgttttaccttacttatactaccacaaatccggctttctgtatagcgtgttcacagtttttttaccaatctgcaaactttgtctgcggcctgctccagctgccgcgccgtcgagtagaacgacagggacagccgcacggttccggtgtcctccgtgcccgccgtccggtgcgcgagcggcgcacagtgcagccccgcccgggtgcacaccccctcgtccgagagcatatccgcaagcacctcactcggcgtgccgggaacgcggaaggacagcacgccggtctgctcctttccggcaaagcactcgattttgctttcgcgggagagcgcacgggcaagctcatgcaccagccgtctctcctgcccggcaatgtgcgccggcgtgaccgcccggacaaaggcgatgcccgccgcgagacccgcgatgccgggcacgttcggcgtgccgctctcgagcgcatccggcagaaaatccggctggcgcatctcctcggacagactgcccgttcctccggtcagcagcggcttcgcggcaatccgagcgtcgagcgccagcagaatgcccgtgcccatcggtccgtacagcgccttgtgtccgggcatgcacaccgccgcaagacacggatagcgctttacgtcaatctctgccacgcccgccgactgcgacgcatccaggatgagcggcacgcctgccgccgtcagcaattccgcgatttcgtccagcggcgcaatgctgccgaacacgttggaaacgtggctgagtatcatcagatcggcaccgtgttccagcgcctgtttcagcgcagaaaccatagccgcgccgtcccacagcggcgtatccagcacggtaggctcgatatttcgagccgtcagcggccgcatgaccgcattgtgctcgtaaccgctcacaatgacgcgggaatccggttttacgagcgcatttatcgcaatattcagcgcatgcgtggcgttcagcgtgaaaatgactcgctccggctcgcccacgccgaacagcgccgctgcctgctcccggcaggcgtacaccagctctcccgctcgatcggctgccgcgtagccgcctcgcgcgtagcctgccgcgccgtacatcgcacggcgaaccgcctgctcgaccgcccgcggcttatacaaggtggtggcagcattatccagatagatcatgtcagtcctcccgcagcacgcggcacggcggcgcaccaagctgccgcagccgatgcacagcccagtccgcctgctgcgcgctcacgcgcaccgcccatccgcaggattcagttcgttcgtgacgcggcgggcgcgcgacctctcccggtacacccaaccgcgccaaatgccgccgcaggccgatggcctcggtctgactgcggcagatcaacagcgcataaccgcccataagggcactcctccctcccaattctgagaaactaaggcaataccgcataattgaacaagagcgctttgtgagtaaattttgcggaccgacgaggcgcagttttgcggtaatacttgatgtattaccgtgaaatttcggcagcgcggacggaactcgcgcaaggaaccgaagccaaagtcaggacacaaaatttccgcaaagcgccgcggcagtgcgaccggagcctgcacaaggagccgcggcagtgcgaccggagcctgcgcaaggagccgcggcagcgcgaccggagcctgcgcaaggagccgcagctttaattgtgcggtgttgtcctaaggtttctcccctcatactatgttgaaatgagcggaaaagtgtgctatgctgattaggttataaactacaatcctgactggagttgaaaacaatggagctttccgccctttccctgcgtctgcgcgcgctttccgtgctgcgcggactgctttcccatccgctggtgcgcgcctacggcgacacgctgaccgcgctcgacggcacagccgccgactttgctgaccgctacggcgcactgtgcgcgacccgcttctcctgcggcgatatcgcgcaggcagtgctcgacgctgtgcactttgacaccaacaccctgaccgataccatcaacgcaccggaagcggctgtgctcaacgccgcaacccacgatctggacgtgctgaacgctctgctcacgctcgacggcgaagccttcaaggccgcagcagcggacaagttctacgagcctgccctcgaggatctgccggacttcgaggccgcggactcgcttccgttctccaccggcgcagcgcttgccgattactaccgcgaggagggctacggcttctttgcacagtcctcggcgtttgccatgcaggatgacggctcggcgaccccgatcgtgcatcccgatgccatccgtctgcacgacctgcccggctacgagatgcagaagcagaaaatcctcaaaaacacgcttgccttcctcgacggacgcgacgccaacaacatcctgctctacggcgacaagggcaccggcaagtcctcgaccgtcaaggcggttgccaacgagtacgccgaccgcggcctgaagatcatcgagatgtctccgcggcagatcacgaatttccccaagctgttcgagcagaccctgcgttcgccgttccgtttcatcgtgttcctcgacgacctgaccttcagcagcgaggatgacaactttgccgcgctcaaggcgttcatcgagggcggtctggccggaaagccgtccaatctggtcatttacgcaacgtccaaccgccgtcatctcatccgcgagagcatggccgaccgtcagggcgatgaggtgcgcgtgcgcgataccctcgagaccgttacctcgctgtccgaccgtttcggtctggagatcaccttctccgtgccggataaggacgagtatctgtacatcgtcgagcagctggccaaggagaacgacctgaaccttgatatcgacgagctgcacctgcttgcagagcgcttcgcgctgcgccgtaacggacgttcgccgcgtaccgcaagacagtttatcagtcagcagctggcggagcagtactccaattaagagtggagagtgaagcgtgaggagtggagagatagcgctccagattcacatgatgcccataataaaaagcagactttcgattgaaagtctgctttttgcttaacagaagagcgaaaagtgaaatcgttacgaactcttcactctcaactctcaactctccactctattaaaattaccagccgaacgaaccaaacggactggagaatccatagctgccgtagccgtcattctgctgcgaattatcgttctggctgctctggctctgctgggtctgggcattcgggtcatcgccctcgaggtcgtgcgaatcggtcagcgtgatggtgatattgagcgtcttgccggtcgaaatgcggtatacgctcagcgtcagcttgtcgccggccttcttatcctgcttgagttcgtttaccttatccatgtccggggtcggggtaccgtcaacggcggtgataacatcaccgacctgcagaccctcactggctgcctttgcgcgggaatcaatggaatatacctgcacgccggacaccttgccgtccgcggactcgacgttctggccggtgatgccgatggacggacggccggaaacataaccgttctgaatcagctcatcaacaatatccttggcggtgttgatcgggatggcaaagcccatgccctcaacggtggcgctgccgaatgcattgccggacagcttagcggacgtgatgccgaccacctgaccgtacttattgatcagtgcgccgccggagttgccgttgttgatggaagcatcggtctgaatcagcgtcataacacggtcattgacggtcagatcgcggttgatggcggaaatacggccgccggtgatggtgttcgcaaactgcacgccgccgggagaaccgatcgcgtaggcatactcgcccggctccagctcatccgagtcaccgaactctgcggcggtcaggtcgcttgtcggcgttaccttgatgaccgcaaggtcggtctgctcatccgtgccgatgatctcggcatcaagagaggtgccgtcgctcagctgtacggaaaccgactgcgcgccgtccacaacgtggttgttggtgatgatgtaaccgtccttgctcatgatgacgcccgagccgctgcccgtgccctcagcggtggtggagataaccgatacgaccgacggattgacctttttgtagatatcctcaccggccatgccgtccgcggtgtcgtagttgtccgaggaattgctcgaatcagactccggcttgctgttgatctgcagcgtcggcgcggaatccgaagttgatgccgaagtgcccgaatcgctgtttgcattgccgccgaacgccatattgccgacaactgcgccgcctgcaaacagcaggcacgcggctgctacgccgcacagaccgagcgctaagcctctgctgtgctttttattcttcggggtgtgcggcttctggctcatcggcggaacctcgccgaagccggtctgctgctgcgcctgacggaactccggatgctgcaccggcgtctggaacggtgtgcgcggctcttctgcctgcggctgctcgttctgcggtgcctgtgcaggctgttctgcctgcggctgctgcatcggctgctcgctctgcggtgcctgttcgggctgttccgcctgcggctgctgcatcggctgctcgctctgcggtgcctgtgcaggctgctcgttctgcggtacggtgttccgggtttcggcggccggctgttcgttattctgatcgctgctgttcagcggtgttttgttgttcatgttgaagtcgtccatgatactgacctcctgttgttattcgcgggaacattccgttccctctgttgatgcttctatcatagtttctcaatgtggcagtttgttgaaaacaatatgaatattttttgaacactgcctgtcgcgaaactacagtttcgccgacaagaggaacggaccgtgggccgttccaaagtcgtccgaaagttcctgttcagaaactttctccctccagaagtccaaaaagggtgatacatgctccccctttttgagcatttgcagagcaaatgctatttcatgcgcactgccgtgcgaaacgcttcaatacagcacatgcagaaaaaagacttccatgcacagtgatagcacatggaagccactttttacgcgttattctgtcggttctgctccggtgcgagcggcagggtgaactcaaactcggtttcaccgccgcccgagcggacggagatctcgccgccgtgcaggttgatgatgttcttcacaatatacaggccgagacccgcgccggtcttatccatcgagcgcgaacggtcggtcttgtagaagcggtcgaacacatgcggcagatcctccgccgaaatgccgatgccggtgttgctgatggcgaatacgcacagctgtccctcctgatggaccttcagcctcagcgtaccgccgtcctcgatgaactttaccgcgttatcggtcaggttgtacaccactcggtacaggtggtcgcggtcacccatgacagtcagccgttcctcgaggtcgcactgcacatccagcttctttttctcaatcttctgctcgaacgagagcaggatctgcgccgtcatttcggtaaagtcgaacggcgccggactgaggatcagctcgccggactgaatttttgcggcatccagcatgcggtttaccatgcgagacaggcgtttggtctcctccgcgatgatcttcaggtacttgtcgcgctggtcgagcggaatcgtgccgtcgatcatgccgtccacaaagccgccgatggtcgtcatcggggtcttgaactcgtggctgacgttggaaataaagccgcgggtcagctcctcgagctggtcaaggtcgcgcgccatgttgttgaacgagaccgccagctcatcaatctcgtagcagcggttgtcctcgggcacgcgcacatcgaagttgccgcccgcaaattccttggcggcggcggcaatcgtcttgagcggacgcgtgacatgctgagagatcatgaacgaaatcaccagcataacgaccagcgtcaccaacatgatgagcacgagcgtctgcgtggagtggcgcaccacgcctgccgaattcgggtcctgcgtggagacgaagatcatcaaatccgcatcgccgttatcatccttgacgcaggttcccaccgtgtaaaacgaggactcactcagcacgccgagcgacccgacagacgcataactgccgtttttgtgcatctccgcaaccacttcagctgagatatgatagccgggcagcgtgtaggtcgtgccgtccggcttggcacccatttcaatgttgccgtccgcgtccgtgatgagcacggtcagctcatcctccttggccacgcgcgcgatggacagcatgtaaatctgacggatcacgtcggagtccgtgccctcgagcagcttgctctgctcggcaaggctctgcacagtcgtgcgcagctcggtctgcttggcgtgcagcgcgtagctgctcatctggtagcagaacaccacgccggccagtgcaaacgcgcacacgatcaaaaccagatgggccacatagtccttgaagaaaaaactgcgtctgcccatgacttactccttggtctcaaacttgtagccgacaccccatacggttttcagctcccacttgtccgaaacgccctctagcttttcgcgcagacgcttgacgtgtacatcaaccgttctcgtgtcaccgaaatagtcaaagccccagacatcgtcgagcagctgtgcgcgggtgaacacgcggttcgggctggacgcgaggaagtacagcagctcgatctccttcggcggcgcatccacgcgcttgcccttgatgaccagatcgtacgcctgcttgtcgatcaccaggttgtcgaacgacagcttctcgggcgcatcatccggcgccatgcggcggaacaccgcacgcacgcgcgcgatgacctccggcatttcgagcggcttgacgatgtagtcgtccgcgcccatctccagaccggaaacgcggtctgcggtctcgcctttggccgtcagcatgatgatcggcacatcgctctccgcgcggatctccttgcacaccgcccagccgtccatcaccggcatcatcacgtcgagcagcagcatgtccggcttgtccgacttccactttttgatgccctccacgccgttttccgcctcgagcaccgtgtagccttcgcgctccagatacaggcgcagcagctcacggatgttggcctcgtcctctacgatcaatatcttcttgggcatagttctcccctgctttcccagtttaatctgattctattatagcgcgtttttgaggaaaaagcattaacaatctgtaaaacaccgctttgcacccgacatttcctgtgctatactgaatatatcaccccaaaggagaattcttatgtcacagacggtagaaatgcacattattgcgcggatacgcagcgatttccccacaaaattcggcattccgcggcagagcggactggcggacgtaccggcacgcattgtattcgagccggaataccgcaacgcggatgcactgcgcggcatagagggcttctcgcatctgtggctgatctggcagttttcggcagccgtgcgcgacggctggtcgccgaccgtgcgcccgcccaagctgggcggcaacaagcgcatcggcgtgtttgcgacacgctcgccgttccggccgaacgagatcggactgtcctcggtgcggcttgaccgcgtggatctcaacacgccggacggcccggtgctgcatatctcgggcgcggacctgatggacggcacgccgattttcgacatcaagccctatcttgcctacacggattcacaccccgaggcacgcggcggttttgcgctcacgaccgatgccgtgcgggttgagtgtccggcgcagctgctcgaaaagctgcccgaggagcggcgtcaaaccctgctgaacgtactcgcacaggacccgagaccgggctatcagcacgaggcaggccgcgtgtacggcttcccgtttgcgggatttgaggtcaaattcaccgtagaaggtgacttgctgaccgttcggcaaatcgagagtcgctaactattctgcggtaaaatttacgcggttcgcgtaccccgtcgattccgtgccgaaaacaaaaaaatcaccgaaacgatttgtttcggtgattttcttttacgttttattagaggccggtcggagtgatcttctcgaagtcctccagcgtgccgccgttcatgaagcagtcgatgatctgcttgccgagcggctcaagctccggcgtatcgaacttcgccagctccttgcggaagaagtcggtcaggatctttgcgcctgcatcgtagccgtcggtgcctacgcggtcctgcgtatcaacacgcaggaacttagagcggatcttctggccgtcgatggtcagatccttcatcgcgtagccgagcagcgggcagcgtgccggctcaaggtgctcgcggcggatctttgcgccgccgtggcgtgccagatactcacgggagatccactcagccgcaaagccgaccttgtaaacgccgatgtgctggttcgggatcaggacgtagcgggtgttcgggctgtccacgatctggtgcagcagcaggttggcctgctttacgcgcttgccggttgcaaacggccagtaggaaccaacgccctcgctcttcagctcgttgccggttacgatagacgggttattgaagccgcgcggtgcgatcaggcgccacagccaagccagtgccggcggaatgatatgcagcatacccatgatgccgtagttcgggttatcgcgggtggaggggggcatacgaacgccgaaagagcgtacgtctacttctaccggctccttgacgatgttcggaacatcccagcgcggcacgatggcacgcgggttggagcacggcttgccgttagaatccagcgtgtgctcccagatcagcagggttgcacccggatggccttccatgttgaagaagcacagcggctccttcggctcggtgcagatgcgctcgtaaaccggatcgcagccgtagtgggttacgccgtccatgcggaggaaccagccgtcctcaccgtcaacgagtaccagcttgccggagttgttctgcacgcccggatagcaggtagccatatcgtcgcacaccggctcaatcttgcaggtggagctgatatgcaggtaggtcttttcgcccgttaccgtgttggtagagagcagcacctcgccgtccggctcgcgggcgatgtcctgcagcatctcgctcttgccgccgccggaagcgccctcgtgcatgatgacaagctcgttctcgtacggggtgatcagacggcctgcggaagtatggcaggtggtccagccctcctgctcgccgatgtcgagcagtaccgagtaaacacccttcttggcagacgggcccggatacaggttataggagaatacctcgtggcagtcatccagacggttgtgaacaacgacctgcttgccgtcgaagtgggtgtgacggaacggaggtgcaacatagatgatcgcacgcggcttgtagccctcggtctcctctgcgcttacaaagccctgcagatgtgccagcgcaaatgcgaagaacgcgcactgcttcgggcatacgagcatggagccgtagccgtactggttgccgccggaattaaacggcatcaggatcagctcctgcgtcttgaaccagtccatggtctcgcggcgcagcttgtcgaacttgtagccgtacacatccgcgaaacgcttcttgtcggtcggcttgtcgtctgcgatgcgcatgcagtccggctcgcggcggcgcatataatcctctacaaagttaacggatgcgccgttcttgcagcgtacaacgtcagcttccttgatctggcccttgcccggtacatcgaatacaacgtcgtacacgtcggcatgttccggaccgaataccatgtcgtacagttccgccttgctggtgggaacaactacgcccttgcagttttcgatcacatcggtcagttcatcggtaaaggtgaatttggtgagcaatgagttcatctgtatcatttcctccttaagcaccgcggagtccctctgccacggtatgctgtacgggcggttaaatcgataaggcggctgcctttgttctttaaccgttgccccattgtctttcgagtatagcataccgcaaaaaccaccctctcgtcaactgtgattttgctttttttgcaagttgaattgcaagttcttgcaaaatgtacaaaacctgatggatttctcactgttttcctgacgcggtcacttgtccgccgatagaactttttgtaaaaacgtttccgcatggcaaaatccgtttcacaatgcgcaatcgtgtatcaaaagtgcgatactgtgcatctgcgtacactttatctcacattccagcgctcccacacgcgggtgacagaattgcattttccgtttctcgtaatatcgaacagcgcaccggcaactgcacagtcgccctcagctgtcttgaaatactcggtcaggtcaccgcgaaacatggcgatagactgctccacgcgcacgccgagcacggacacgatcgggccggtcatgccgatatccgtgatataaccggtgcccttgggattgacgcgctcatccgcggtctgcacatgtgtgtgcgtgccccagacagccgccgcgcggccatcgaggtaatagcccatagccagcttttcgctcgtggcgttcgcgtggatttcggcaagcgccacgtcgtacatgccctcgttttccttgaggatgcggtctgcacacaggaacggattgtccgggccgtatttcatgtcgcagcggccgatcaggttcatgacgagcaggcgcatgccctgcgggccgtcataaatgctccagccccggccggggctttgcggcgcaagattggccggacggagaacatccgaacggctgtccagatacggcacgatctgctgcttgccgaacacatggttgccgagcgtgatcacgtccgcgccggcggcaaaaatatcatccgcctgacgcgggagaacgccgttgccggccgcattttcgccgtttacgatgacgaaatccgcgccggtgtcgcgcttgatgcggcggagcaggccgtgaagcgcgtcgatacccgcctcaccgaccacatcgccgatgactaatagtttcatggattacctctttctatcattgctgcaagccgttgattggttccgctggattcagcgaggagtgcgccgccgctgcggcgggaacgtgccgcgccccgcggcgagggagtgcgctgacgccgcgcgggggactgccgcgccccgcggcggggcaagagggtagacacctacggtttctaccctcttaactcccgtttccctttgtttccgagtctggcgcagattaccgacatgtgaccgcttcgaaaatggggaacggcagtcgggttactcttgcgtttgtttcgcaacatattcgccgttcacagatagtgtactgctacacatacgggctgctctacgcaggcgcggcataaccgtgccgcgcaactctttaacacgttgtaccgcacggcacctgcgattcaggcgtttggtacagtttatcttcgcaggccctgtctattataacgtgccaacaagttgcgcaacacgggtatgttgcgccctgcggagatgaaaccacatgtgtagcagtacgttatatgatactgcgaatatgtctcgacatgggagcacactgtgctcccctacggaagaaaaaatcctctgccgttccccttttcggagcggtcgccgctctctggtctgcgtcaggctatctaacaagggaaaggtaggagttcaaagaggaaggaaaaccgcaggttgtccttcctttttgcccccgcggcgggtgccgcgacgctcccgccgtccgcagacggcgaatccccccgctgaggttcagcgaaaaactctccgcccgtcaggggcgaacccgctgacgccgttcgtgtcccccgctcagccggtgcaggaaatacatacaaaaaagagctgctgcgcaatgcaacagctctttcgtctgttaatcttaatcgaacagggtcgaaaccgaagtttcctcgtagatacgcgcgatcgcctcggtgaacaccggtgcaaccggcaggacgttgatcttatccagcttcttgtcgttggtcagcgggatggtatcgaggatggtcagctccttgatcgggctgttctggatgcgctcgatcgccggaccggacagtacgccgtggcttgcacaggcgtaaacctcggtcgcgccgccgcgctctaccagagcgtccgctgcgtgtacgagcgtgcctgcagtgtcgatcaggtcgtcaaccagaatgcacttcttgccctctacgttgccgatgatgttcataacctcggatacgttggccttcggacggcgcttgtcgatgatggcaagcggcatatccagcttctgggtgaacttgcgggcacgggtaaccgaacccagatcgggagaaacgataacggtatcatcggtgccgacgccgaacttgcccgcaatgtacgggatcagaacggaagaaccgagcatgttatccaccggaatgtcaaagaagccctggatctgtgcagcgtgcaggtccatggtcagcacgcggtcagcgcctgcagcagtaatgaggtttgcgaccagctttgcggagatcgggtcacgcgccttgctcttgcggtcctgacgagcgtagccgaaatacgggattacagccgtgatacggcctgccgatgcacgcttgcaggagtcgatcatgatgagcagctccatcaggttgttgtttaccggaccgcaggtggactgtacgaggaacacgtccgagccgcgaacggattccgaaatggaaaccgagatttcgccgtcagcgaaggtggagatggcagccttgccgatcggcagtccgagcgcagaagcgatctgcatcgccagtgcgggatgggagttgccggagaaaattttgatgttttttccgtgagaaatcattgatttgcctccgtcatataaatatattttttgttccgtgtggatttatatacgtttttatggatttacttttcgtccttctcgtgtgcggcgcggcggcggtcgttccagccctcaagattggtctggcgggaacgtgcaacgctcagcgcaccggcaggaacgtccttggtgacagtcgtaccggcagccgtaaacgcacggtcgcccagcttgacaggcgaaacgaggttggtattgcagccgatgaagcagtcgtcaccgatctcggtgcggtacttgtgatagccgtcgtagttgacaacgaccgtgccgcagccgaagttgacgcgctcgccgacggtcgcgtcgccgatataggtcaggtgcgacaccttggtgccgttgccgatggtggacttcttcagctctacgaagtcgccgatgcggcagccgtcaccgaccacgctctgcgggcggatataggcaaacggaccgaccgtggtattgctgccgacggtggattcataaacctgcgaattgtttaccgtggtgcctgcgccgatctcggccttttcgaggatggtgttcgggccgatgaccgcgcccgcgccgaccttgcagccgggacggatgtgacagccgggcagaatggtcgcgcccggagcaatatcagcgtccggcgcaatgtaggtgctggtcagatcgaagatctgcacgccctttttaatcaggccgtagttgacacgctgcatcatctcgacctgcgccataaaggcggcagtgccgtcgcagatgacgtaaatcttgttggtgatagcaatgcccttctgcgcaccggctgcaacagccgccgcaaccaggccgtcgagcgtatcagcgccgctcgcgagtgcctttttcagcatatcccaggtgaacatggcggcatagcagcggctgtctctcggcagaggctgaccttccgcatcaaagccctgctgctcggcagacagtacgctgacgccgtaaccggtgttcaggtgcgtctccgccagatggaacagagcgtcctcctcggccagtgcaaacggagccgccagcaccagaacgtgctcgctctccggcagcgcagccagcgaggcaaaacgatttgcggcatcgagcgcgatgtcctgtgcgccggcaacggcagactctctgtcgtcgtgcgcaaagaagcacgcctccaccgcatcaggcaacgcatcccgcattgcatcgcccgcagtgccgaacaacaccggacgcgcaaaagcggaaatgccgttttcgtcaaacaggccgccaaccatgacggcatttactttattcatcgcagaaatcctttcgtttctcaagggtcatacgaccagattttccgatatagctttattatacaacagtatgccgcaaattgcattatcatttttcgataaatttcttctcaccgcataatatttttcgccgtttgcatacaaaggccgcaaagcaagcattttggtgggaattgaagtaatggagaattgagatacccaccgcagtgggcgtccagcgagcaaccgccgcaggcggctcttagcgagtcggaatggaggatggcgattcgtgtggagagtgaagatcacgccaaccgcgaaccacgttcgcggcatacaatacgcggtttgcttgcataaccgcacccacaaggcagacagcgcgtgtcgccgagccttccgcgggcgaccgcgtttccgccacccataaaatcccgcagggatttctgcacccagagaacccatcacgccgcggagcgcatcataaaatggagcacgtgcgcgacaaaaatggcaggacatgcgcctgccatttttaacaaacagtaaaacaccccgaaaaccggaaagttttcggggtgttttgctgcaacagatgttcccgccctgtccgtgaaacggacacgcgcggcgacaccgtccctcgattcaaaggacaagtcctttgaatcgaaacagccgcaggcttttagccctgtacagctactacttctacctcaaccttagcgccgagcggcagagcagctacttcaacgcaggaacgagccggagcgccttccgggaaatacttcgcgtatacgccgttgaatgcagcaaagtcgttgatgtcggacaggaagcaggtggtcttgactacgcggtcaaaggacacgccgccctgtgccagaacgcactgcaggttcttcataacctgctcggtctgctcctcgatggtggttgctacaatcttgcccgccttcgggtcgatcggaacctgaccggaggtaaagacgaaaccgtttgcagcgattgcctgagagtacgggcctactgctgccggtgcgagatcagtgtgcagaacttccttgatagccatggtgggaattctcctttatatatctttattttttgataacagggtgaaatgagtgcttttgtgcataaaatccgcacagaaacgcaattgtggcgtagccagtggtaacgacgcacggttcatcgagagcgatttacgagcaaattttgcgtcttgattaggcacggctttgcagcaatactttgtgtattgcaaaaagccggaacaacatcaaggcacaaaatttccgtaaagcgccgaagatgcaaccgtgtggcgttgccacaatcacttcttgccgcccttggtcttcttcagacgctcggtgttggacagaacgcgcttgcgcatacggatgctctccggagtgatctcaagcagctcatcgtcggagatgaactcgagtgccgcttcgatggacatctggcgcggcggaatcaggcgcagcgcatcatccgagccggatgcacgcatgttggtcagctgcttcttcttgcagacgtttacagccatgtcctcgccgcgcgggttctcgccgacgatcatgccttcgtataccatcgtgccggggccgatgaacagcgggccgcgatcctgtgcgttgaacaggccgtagccgacagcctcgccggcctcaaacgcgatcagagaaccggtggtgcgcttctggatatcgcccttgtacggctgatagccgttgaatacggaggacataacgccctcgcccttggtatcggtcaggaactcggtgcggtagccgaacaggccgcgtgccggaatgatgaactccaggcgcatacggtcggtgcccttcgggttcatggaaaccagctcgcccttacgagcgcccatcttctccatgatcgcgccgactgcatcggccggaacgtccgcgatcatgcgctccatcggctcacaggtcttgccgtcgatctccttgagcagtgccttcggtgcgccgacctggaactcgtagccctcacggcgcaggttctcgatcaggatggacaggtgcatctcaccgcggccgcaaacgcggaatgcgtcggtggtgtcggtttcgtttacgcgcagggatacgtccttgagcagctcacggaacaggcgctcacgcaggtggcgggaggtgacaaacttgccttccttgccggcgaacggagagtcgttgaccataaaggtcatctcaacggtcggctcggaaatcttaacgaacggcagagcctcaacgtgctcggggtcgcacagggtctcaccgatggttacgccctcgatgccggagaagcaaacgatctcgcctgcctgtgcctcctcgatcggctgacggctcagctcctcgatggagtacagggtaaccagctttgcgttatacggcttggtgttgccgtggtagtcgcagacggtaacctgctgacctaccttcatcgagccgcgctcgatacggccgatgccgatacggccaacgtactcgttgtagtcaatagaagaaacgagcatctgggtcgggccttcggtatcaacatgcggcgccggaatgtgctcgaggatctgctcgaacagcggggtcaggtccttgccctccacgttcggggacatggaagcggtgcctgcacggccggagcagtaaacgatcgggctgtccagctgctcgtcggtcgcatcaaggttgagcagcagctcgagaacctcgtcgccaatctcgttgagacgagcgtccggacggtcgatcttgttgattgcaatgatgatcttgtgaccgaactccagtgccttctgcagcacgaagcgggtctgcggcatcgggccttctgctgcgtcaaccagcagaacaacgccgtctaccatcttgaggatacgctctacctcgccggagaagtcggcgtggcccggggtatctacgatgttgatctttacgcccttgtaatgtacagaggtgttctttgccagaatggtaatgccgcgctcacgctcgatgtcgcccgagtccatgacacgctcctctaccacctgattttcgcggaaagcgccagcctgcttgagcatctgatcgaccagagtagtcttgccatggtcaacgtgcgcaatgatggcgatgttgcgtaaatcgttacggatcatatattctattcctccatcagcgggattattttcgtacagaatttattatacccgttttttcgttcattttccacctattttatcgtcaaaattacggcgatatatccgctctaaattgtaaaatattttaccggactgagaaatctccccatgttttccggttgacgcaggcttactcctgccgtacaataaagaaaagacgcaagcgtctgataaaaggaaggagaatctctatgaataaaatcggaaaggcaatgctctgcaccgtactgaccggcgcaatggctgtcggcgccgcaggcgcggctgacctcggttccctgtctccgcagggtgctaaggcgtatctgaatcagatcaccaccctgcagaataagtatggcaaggctgccgcccgcacggacgatggcttcaagggactgctgactggtctctcgatggcaaagctggtggatatggacggcgataagattccggagctgtactgcgctgccgctcaccaaggtcagcatatgtactcgtatgcagacggcaaaatctatgaacttgtaatccccgaagacgtgagcaacttcggcacggatgtttcgccgtgcacccagttttacgttggcaaagacaaggcgtatctggtctctggtcaggaagtaatgaataacaatccggtcaccttctggaccaaacagggcgataaagccgttgtggtcctcacctacacggacggcttcgactgggatgccgagacaccgacaccagtcaaaactatcaacggtcagtccgttaccgcagaggaattttcttccgctattctcgacttcaccggcgatatggacgagcagtattactccttctgggaaagcccttacaacagcgaccgtgcgctgtctccgcgtgcggctctgcaggacaccatcacctccctgcgtaaactcaccaacccgaccgcacatgtttcccgccacaaggtaacgctcaacggcgcaaaggctgatctggcggcctataccatcaacggcagcaactatttcaagctgcgcgatctcgcaaaagcacttaaaggtctggattctgaatttgaggtaaagtggaacgccgcccagcagcgcatcgacctgaccagcaagaccgcctacaccgcggtcggcggcgagcaggctgccctgcccgccggcaataaggctgcatctctcacgaacgcctccgtttatctggacggcaagccgctttccctcaccgcctactccatcggcggcaataattatttcaagctgcgcgacctcggtgacgcgctcggtttttccgtggattggaacgcggacaccatgactatgatcctgaccgtgaaataaaaacaaaggggattgaacaatgaaaaaaaatcagtaaagtattgctctgcgcggcactgaccggcgcaatggctgtcggcgcggcaggcgcggcggaccttggttcgctgacgccgcaaggcgcaaaggcgtatctggatcagatcgtaaagctgcagaatcagtatggtaaagcccattcctataaccgattgaatccgcatatctggaaaggtctttgcttggctactctgatcgacatggataaggacggcattcccgaattgtactgcagcgcttctactgacggtcaaagcctgtacacctatgcaaacggtcagttaaagcagcttaacattcctaagcaggttagcaatttcggcaccgattattgcccctctaccgagtttcaattcggcaaatcaaacatctatcttgtagatgggcaggaaatcatgaacggcggtccggtcagctatttgaccaagcgcggtgatgaaatcgtcagtgacttcacctacatcaattaccagttcactaataagccgatctacaaggtaaatggacagagtgtttcccggacgaccttggaagcttccattaaaaactttgaaaaagatttgaccgaaaaaagctattgctacttttctgagtggacaacaaactcccccagcggtactgttgcaaacaccatcacctccttgcgtaaactcaccaacccgaccgcacatgtttcccgccataaggtaacactcaacggcgcaaaggctgatctggctgcgtacaccatcaacggcagcaactacttcaagctgcgcgatcttgcgaaagcactcgacggtctgaacaccaattttgaggtaacgtggaatgccgcacagcagcgcattgacctgaccagtaaaaccgcctacaccgcagtcggcggcgagcaggccgccctgcctgccggcaataaggccgcatctctcacgaacgcctccgtttatctggacggcaagccgctgaatctgaccgcctactctatcggcggcaataattatttcaagctgcgcgacctcggtgacgcactcggcttttccgtggattggaacgcgaacaccatgactatgatcctgaccgtgaaataaaaacacgctgcacacagcaaaaaagccaccgtttcaaagaaacggtggctttttcatgctcaaaacgaaatcttactggtttgcttcgatgtagtttacgatgtcaccgatggtgctcatcttagcagcttcctcgtcggaaatcgttacgccgaagttctcctcgaggtccatcatcagctctacaacgtccagagaatctgcgttcaggtcttccttaaccttggtgtccatggtcatggtggaagcatcagcgtcaaacttgtctgccaggatttcacataccttttcaaacatgggatttacactccttcattactttcttgatttattgttctgaaaactccgactctgcggaatttttcataccgtttctgcagcatcgtgtcgatgtccggctcagcatccagctcggcaagctggtcgcgcagcgtgcgcgccacattgcggataagctgtgcggaggatgtgccctcctgaatgatgccttcgatcataccgaagctgtacaggtcctgcgcggtgatatgcagcgtgtccgctgcctccgcctcgcgcttggggtccttccagagaatggacgcgcagccgcgcggcgaaataaccgaatacagggcgttctcgagcatgagcacacggtctgccaccgccagcgccagcgcgccgccggagccgccctcacccgtcacgatagagataacaggcgttttcagctcgataaactcatacaaacagcgggcaatggcctcgccctgaccgcgttcctccgcgccaacgccgcagaatgcgccgccggtgtcaacaaagttgatgaccgggcggtggaatttctccgcctgatgtgcgagacgcagggcctttcgatagccctccgggtgcgccatgccgaagttggcgtccatattctgctcaatggtgcggcccttgcggtggccgattaccgtcaccggtgtgccgttgaagtagccaacgccgccgaggatggcatggtcgtccgaaaaaaagcggtcgccgtgcagctcggtgaagtcggtgaacagctcattgatataatccgtgatcatcggacgcttggtatcgtgaatgatacgcattttttcacttgcgggtttgttagtcacggcgccacacctgccatttcttggacttggagccgcagtgcagcttcaagagtttttccagcgtttctctgagttgattacgcggaactattttatcacagaaaccgtgcgatagcaagaactccgaggactgaaaatcgtccgggagggtctgaccgatggttccctcgataacacggcggccggcaaagccgatggtcgtgcgcggctccgcgaggataatatcgcccagcatggcgaacgacgcggtaacgccgcccgtggtcgggtcggtcagcacggtgatatacagcaggcccgcgtccgagtgacggcgcgccgccgcggacacctttgccatctgcaggagcgaaaacatgccctcctgcatgcgcgcaccgccggagcaggtgaacagcacgacaggcagacccttttcggtcgcgtactcgaacagacgagtcagcttttcaccgacgaccgaacccatggacgccatcatgaaatggctgtccatcacgccgatcgcggtttctacgccgccgatcttacacacgccggtcttgactgcgtccggcatgccgaccttttcagccagctctgtcgttttctctgcgtatcccgggaagtggatcgggtccgccggtgccagattggcgtacagctcctcaaagctgtccttatccgcgatctgacggatgcgcgtgcgcgcgagcagtcgtccgtagcgtccgcagtgcgggcacacatacagattcttgccgtaggcatacgccttcagttctgcgccgcagcccttgcaggttacgaccttggccgcttcgtcctcctgcggtttcatttccatagaggtctcgcgtgttttttgaaacaggtcgatcagacccatgcgtaactcccctttcgtttggaggcagtaccgcacgattggccttcggcgctttgcggctgttttgccccctggttttgttgcgtacttttgcaatacacaaagtattgctgcaagtccgcgccgcaccagtgaacaaaccatctcgcaaatcgctcttgtccaaccgtgcggtactgcctctgaaatccttcggattacaaaaacttcgcttttcaaaatacgctgattttgtaagaccttcggattccattatttctacgctaaatctattataccataataaatgatttagtcaaaatcgccgtttgcgatggaattaacattaaagtttgcttccacaaacgccttcgagcacaggatgtgcatctggtagtcggttgcggtcacaacgccctcaaacagcatctcagcgagggcacggcgcatacggacgatggcctgctcacggtcggcgccgtaaacgatcagcttgccgatcatagaatcgtagaacggcgggatcttgtagccctgatacgccgcagaatccacgcgcacgccgggaccgcccggcagatgcaaggacaccagtgtgcccggacagggcgcaaagtttctcgacgggtcctccgcgttgatgcggcactcgatggcgtgaccgcggatggtcagatcctcctgcttaaaggacagcggctcgcctgccgccacgcgaagctgctcgcagaccagatctacgccggtgacctcctcggtgaccgggtgctcgacctgaatgcgggtgttcatctcgcagaagtagaaattgcggtcgttatcgaccagaaattcgatcgtacccgcgtttcggtagccgacgcgctttgccagcgcaacagccgccgaggtcatcttctcgcgcagctcgggcgtgacgaaagccgacggactttcctcgatcagcttctggtggcggcgctgcaccgagcactcacgctcgaacaggtgcaccacgttgccgtagttatcgcccagaatctgcacctcgatatggcgcggattgtgaatatatttttccatgtacaggcggccgtcaccgaagttggcgatagcctctgcagaggcgctgtcgtacgcgtccttgaggtccttgacgctctccgccacgcggatgcccttgccgccgccgccggatgccgccttgagcatgaccggatagccgatgcgctcggcctcggagatggcttcgtcaaaatcgcgcagcggaccgtccgtgccgagcgcgaccggaacgcctgcagcgatcgcgttgcgctttgcctcggatttgtctcccatcagacggatggttgccgcagtcgggccgataaacgccagaccggcctgcgtgatacgctcggcaaaatccggattctcggacaggaagccgaagcccggatgaatggcctgacagccggaagccagcgccgccgaaatgatattatccatattcaggtagctgtccgccgcacgggccggaccgatgcagaccgcttcgtccgcgatctgcgcgtgcagcgcttcgcggtcagcctcggagtaaacggccaccgagataatgcctaaatcacggcaggcctgaataatgcggaccgcaatctcgccgcggttcgcaatgagtaccttctgaaacattcgattagctctctcccgcctcagtcattgatgaccatgcatttgatctccgcttcggcggccttctcgtcaccgacccaggcaatgccctcggctactgccatcgggccgcggcgcttggtgaaggtaacttccagacgaagggtatcgcccggctttgccattgcgcggaatttcgccttgtcaatgccggtgtagaccgcagtcttgcccttgaattcgggcagagacagcagcgctacgccgcctgcctgcgcgagcgcctccagacggaacaccgcgggcataatcgggttgcccggaaagtggccctggaagaagaactcgtcaccggtcaggtgcagcgcaccgactacatggttctcgtccatttcgaggatctcgtccaccagaagcatcggcggacggtgcggaaggatctccatgatctgttctttgttcagcatattataatccctctcaatctaaaaagcaagataattaccgcaaaactacagttttgccggtaataggaacggatcgtggaccgttcccaagtcgtacgaaagttcctcccgtcggtcgaaactttctccctctatcggtataaaaacggtgatacttgctccccgtttttatgaatttgctatgcaaattctattgaatccgcgctgatgcgcggcagatgcttacgtcttactcaataacacaaaggacttggttatactccaccatatcgcccggctgcgccataatgcggatgaccttgccgtcgcacggtgccttgatctcgttcatgatcttcatcgcctcgatgatgcagagggtatcgccctccttcacctgctgaccgaccagcacgaacggcggttcgtccggagacggagaagaataaaacgtgccgaccagcgggctcttgacctgcgtgcctgccggaagctgctcctctgccggtgccgcgtctgcgctctccgctgcgggtgctgccgccggcgccgctgcgggtgccgccgctgctaccggtgctgcagcgatcacgggagccggttcagctgccttgatcttgatttttgcgtcatccagctcgagctcgacctcgcccagcttttttgcagccagcgcgtccatcagctcaagcgcgatgtctttcagttctttgatgtccatttttataccttcttgatcaggatgcaggcgttgtggccgccaaagccgagcgagttggagatggcaacattgatcggcatctcaaccgccttgttcggggtgatatccagatcacactccggatccggctccttgtagccgatggtcggcggtacaatgccctcacggattgccataacgcaggcaatggcctcaaccgcagccgcgccgcccagcagatggccggtcatggacttggtggaggatacctttacgttgtaagcctcgtcgccgaacgcctttttgatggcgatggtctcgtacttttcattcagcggcgtggaggtgccgtgcgcgttgatgtagtcaacgtcagccggggtcagaccggcatcctcaatggcaccgcggatggcatgcgccgctgcttcgccgtccggagacggactggtgatgtggtaagcgtcgccggaggcaccgtagcctgctacctctgccagaatggtcgcgccgcgctgctgtgcgtgcgtcaggctctcgagtacgagacagcctgcgccttcgcccatgacaaagccggaacggcgtgcatcaaacgggatggaagccgccgtcgggtcctcgcccatgtgaaccgccttcatgttctggaagcctgccatcgagatcgggataatgccgttctcggtgccgccgcagacaacaacgtcctgatagccgtggcggatggcgcgcattgcctcaccgatggagtggttgccggtcgcgcacgcggagaccgggcagaaattctcgcccttgaagccgaagtgcatggagatatacgccgccgcgatgttggcgatcatctccgggatagcgaacggcgaaacgcggccgggacccttttcgagcagcttcgggacctcctgctctgcaacgtgcagaccgcctacgcccgagccgaagataacgcccgtgcgatagggatcgaaattgccttccttgaggcctgcctgctcgacagcctgaaccgctgccgccattgcgtaatgcacatttgcgtctgcgcggcgcgcctcacgcttctccatatactgggtcgggtcgaagtccttgacctctgcacccagctttaccttaaaatcggatacatcaaacttggtgatgggaccgatgccgcacttgccggtcttgagcgactcccaaaacgacggcacatcgttgccgaccggagtgatggcacccatgccggtgattactacacgttccatatatttgctccttcattccagtatcacgaccgtacccctgtacggtgttaaatcttaatataatccgccgtccgcgatgatcgtctggccggaaatatagcttgcagcgtcggaagccagaaaggcaaccacgcctgcgatctcctccggcttgccgaaacggccgagcgcgatctgcttcttggcgttctcgcggatgtcctcgggcaccttgtcgctcatctcggtggcgatccagcccggagcgaccgcgtttactgtaatgccgcgcgcacccagctccttggcggcggtcttggtcatgccgaccatacccgccttggcagcggtgtagttgatctggccgtagtttccggtgaacgccgaaaccgaggtgatgttgatgatgcggccctgctttgcgcgcatcatcatcgcaccgcacaggctgagcatgttgaatgcgcccttgaggttggtgcggataacgtcgtcgaactggtcctccttcatgcggaccatcagaccgtcgcgggtgatgcccgcattgttgacgagaacgaacggtacgccgatctcttccttaatttccttgagcgcggtgctgcaggcgttatagtccgcaacatcccacttcttcacataagcgttgacgccgtgcgcgcggcacttctccgccacagcctcagccttttcgaccgaggacgcacaattgatgaggacgtcgaagccgtcctgcgccagcttttccgcgattgccgcgccaatgccgcgggaaccgccggttacgattgctaagctcattgtttactccattctataggcaggcaggagtgaggagttttcgtatctcttcactctccgctcttattcaaatctcttgtaagcgttcttcagaaggtcctctgcctgcgcggtcatgcccttgaggatctcctcgcacggatgcagctccttgagcatacccgcaatctgaccggacataaaggtgccctcctcatagttgccgtcctgcacggccttgcgcagcgaaccggcggttgccttctcaagctcctcaagggaggcattggtgttctgcttctcgagctcgaggcacttgcgcgccatcggggtcttgagcgaacgcaccggatgaccggacggacgaccggtaacaacggtcgaaatgtcggtagccttgaggacgagctccttgtacttatccgaaatgtagcactcgttggatgcgaggaacacggtgccgcactgtacgccttcggcgccgagcatcatggcagctgccatgccgcggccgtctgcaatgccgcctgcggcgatgaccgggatgctcagtgcgtctacaacctgcggaacgagcggcatggtggtcagctcaccgatgtggccgccgccttccataccctctgcgataaccgcatctgcacctgcgcgctccatgcgctttgccagtgcaaccgaagcgacgaccggcataaccttaatgcctgcgttcttccagtccgcgatatacttgcccggattgcctgcgccggtggtcagcacttcgatcttctcgtcgatggctagctgtgccagatcgtccgcattcggggagagcagcatgatgttcataccgagcggcttgtccgtgatggcacgcgccttatggatctcctcacggatgtaatcgaccggagccgcgccgcccgcgataatgcccagaccgcctgccttggaaaccgcagcagccagatggtgctctgcgatccacgccatagcgccctgcacgatcgggtattcgataccgagaagttctgtgatcttggttttcataggtcattctccccttttatacaggtaatttcttgtaattctaaatctatcaagttattatagcatatttttcacgaaatgtaaccaaatgttattgcgctgaatatctggtatcgtacatttctgatggatattgtactgtaattataatttcagcacaaaagcgccataagtaagtcctccgccaaagccggtgcagacaatggtctgaccctcgtgcagcaggccgttcttacgcatttcgttcaggcagatcggcacgcttgccgacgaggtattgccgaaacggtccatattgacgtagatcttctccttcggcagatggtatctgcgtgcaataacatccagaatacgcagattcgcctgatgcggcaccacccagtcgatttcctctgcggtgacgcccgcccgcttgagtgcagtgtcgatcgcaagcggtacggctcttgcggtgaagcgcacgaccggtgcaccctgcattttcaggaaacgcgccttcgggtccaccgtgcggtcaccggaaagcggatcctcgaccggcagggcttccatgtgcaggtactctgcacccgagccgtctgccgcggtgaaggtggacagaatgccgaccgtttcgtcctcagtcgcctgataaacggctgcagcggcaccgtcgccgaacagaatgcaggtcgagcggtcggtgtagtccacgatgcgcgaaagcgtttccgccgagacaaccagtacggtctttgccttaccggatttaatgtaactgtccgcaatgtcggtcgcggagacaaagccggtgcaggcattgttgatatcaaacgcgccgacctgacgcgcacccagcttgtcctgcaggatagacgccgtattcggcgtgttggtatccggcgagcaggtgctgacgagaatgaggtccagctcctctgcggtgatgcctgcgtccgcgagtgcgtcctgtgcggcaccgagcgccagctcccatgtatgtgtattctttgcgatgcggcgctcgcgcacaccggtgcgctgcacgatccactcatcgttggtatcgaccattttttccagcatggcgttggtcaggacaaaatccggaatgcaggcgcccgtgccgatcagtttactgttgatgatttccacgctcctaaaaagtccaaatcgctctcccaaaaagcgtggaaaagcgacaatagttagattgacaaagtattctccgactattataataaaagcacagtaaattgtcaagacagaccgttattatttagcaacactttgtgtgaagaatatctattaaaatacggtgctgtcagcgtttgattattattttggaggaacgaaacgtgaactacggttttgcatttttcccgggtcagggcgcacaggcccccggcatgggcaaggatctttatgagaactcgcaggctgccaagctggtttttgaggaagcaagcgaaggcgccggtctggatgtagccaagctgtgctttgagagcgacaaggcaacgctctcccgcacggagaacagccagatcgcgattttcacccattccatggcagcctgggctgcactgaaggaagcaggcgtggaattcaaggcagcggcaggcttctcgctcggtgaatacaccgcactggcggctgcaggcgttgtttccctcgcagacggcgtgaagatcgtttccatgcgcggcaagctgatgcagcaggcagcggactcgatcgacggcggcatggcggctatcctcggtctggaggacagcgcaattgaagaagcctgcgcgaaggtgacctccggcgtggtccgtccggtaaactacaactgcccgggtcagctggttattgcaggtgaaaaggcggctctcgcagaggcgatcgagaactgcaaggctgccggtgcacgccgtgcgctcccgcttgcggtatccggtgcattccataccccgctgatggcaaaggctgccgcagagctgcgcgcttacgttgcggactttaccttctccgcaccgaagatggatatttactccaacctcgacggcaaggtttacgactgctccgacctgccggcacatctcgagcagcacatgatctctccggtccgctggacgcagctggtgaagaacggcatggctgccggtctgacctcggcgtgcgagattggcccgggcaagacgctgaccggctttgcgggcaagatcagcaaggagctgacctgcaagaccgtacaggatatggcgggcgtcgaagccgcctgccactaagggggacgctgtcccccttagttaccgaggcagtttccttgggaactgcctcggataaccccctctcgtccgcacggcggacgaggctcgggacacgtgtcccgaggcagtgggataaaagtcaggtacacgccctgacttttatagagaattgaatgcggcgcactgcggtgcgcctgtcctgcctgtttctgctttgccgaaatgcggcaggagctgcaaaaaaaattgcacgcccttaggcgtgctctttttttgctgtggaacggtaaaatccgctttatcccagaaaacccaaatgctccagcaggattttgagacccatcaaaatcagcacgataccgccgaacagctctgcgcgggacttgtactttgtgccgaacacatggccgatctttacaccgatgcacgacagcacaaacgtggttgcaccgatgaacgacaccgccggaacgatatcgacctgcaggaacgcaaacgtcacaccgaccgcaagcgcgtcaatgctcgtggcaaccgcaagcggcagcatggtcataaagcggaacgaatcgctgacgctttcgtcatcgtgctcgcgcgactcgcgcaccatgtttgcgccaataagccccagcagcacgaaggcgatccagtgatcaatgctcgtgatgagcgactgaaagcgcacgccgagtgcaaagccgatgagcggcattaaaagctgaaagccgccgaaatacagtccgcagatgaccgcgtgcttagccttgagcgtgcgcacgctcagtcccttgcagacagacaccgcgaacgcatccatcgacagaccgactgcgatcaaaaataactccagcaaacccattttcttgtcctcctcagtcgtttatccggcggaaaacaggcacaaaaaaagacccatctgccgcgtagaacagataagtctcgtcatttcatgcaaaaccagaggagcgtcctccccagtatgttggctctgccgcgcggcggaacaaccgcgccgactactcccttattgcgctttatgatagcatatgcacacaaaaatgtcaatatgcgcaccgaattgttgctcttggcaaactgcggcgcccgccgctgagggcaaaaagggtagacacctacggtttctaccctctttgaacacccgtttcccttggtagcctaccttgggtgcagacggtagactgcgtaagcaggaaaaggggaacggcagtcggtctaccgctcaatcgctttctccgccttttcgcaattcacagacagcgtactgctacacatgcgggttaatcaacgcagagtgcggcatgacagtgccgcacaattcgtcagcgcgttatgatggacagggcctgcgaggataaatgctactaaatagatagattcgtaggtgctgtctgtaacctccagactaacaaattgcgcgacacgggtatgttgcgcctgctggaagtagccgacctgtgtagcagaacggtatctgacactgcgaataagttgagaaagacacggaagaaaaaatcctctgtcgttcccccatttcgcagcggtcacatgtcggcaatctgcgccagactatctaacaagggaaaggtaggagttcaaagaggaagggaaaccatgggtgtcccttcctctttgctcccgcggcgagtgccgcagtcccccgctgtgccacagcgcactcttcgcccagaaacggcgaaccgttcacacggttcgggcacaccggaaagtctgtgccgagaaatcttcgctcgaaaagcgcacgccggtcaactcccccaacgttttcccttgtgcaatgccgcaaaatgcgctatacttattttatatgacttgaaaaaagaggttacaacaatgaaactccaaaccagactggcggtgctggtgtgcaaggcatcgggcgctgtcctgcgcaggctgggacgcggcggcaccaacctgccgggcaagctggcactgaaaattgataaaaatattctgggtgagctgtcgcgcggcgtaaaggtcacggtcgtgaccggcacgaacggcaagaccaccacctcccgcatgatcgagcaggcgttcgccgatgcgggactcaaatatttctccaacaagtcgggcgcgaacctgctgaccggcatcatcgcggtatttgcacagcattccacgctgtccggcaaatgcccgtacacgcacgcgctcatcgagtgcgacgaggcagccttccgcaaaacgagcgaatacctgccggtcgaatgtctggtcgtcaacaacatcttccgcgaccagcttgaccgctacggcgaaattacgcacacgctcaacgccatccgcgagggcattacgcatgtgccgaatgcaacgctctgcctgaacgcggactgctcgctcaccgcttcccttgcggacagcgtgccgaacaagatcgtctggttcggcgtgaatgtcccgatttacaaggagaccgctcacgagctgtccgacgcgccgtactgcatccactgcaagaccgaatatgagtacgattacatcacctacggccatctcggcggcttccgctgcccgaagtgcggctaccaccgccagacgccgcaggtcgctgtcaccaaggtgctcgccaccggcgcggactcgtccgacatcatactggacatcttcggtcacgagcacgaggtacacgtcaacctgccgggcggctacaacatctacaacgccgccgcagaagccgctgtcgcgcatgttgtcggcattgatgagcagaccgcggtcagcgcactttcacagttcgaatgcggcttcggccgtgccgagcagttcaaactcggtcaggcacaggcgcgcatgatgctggttaagaatcctgccggcttcaatcaggtcatcaacctgatcgcgcacgatgagggcaattacaagctggcatttctgctcaacgaccgcttcgcggacggcacggacatcagctggatctgggacgttgacttcgaggcactcgccgaccagcaggtgcgctttacacgcgtactggtttccggcgtgcgtgcggatgatatggcgctgcgtctcaagtacgcaggctttgcccccgagcgtatcgaggttatccgcgagtacgacaggctgctgaccgagatcggctcggatgagacaccggcattccttatgccgacatacaccgccatgttcgacctgcgcggtgagatcagcaagcacaccgacgttaaggcgttctacgaataagggggaaactgcaatggaactgaatatctgccatctttaccccgacattctcaatctgtacggtgaccggggcaacattatcacgatgaagcgccgtctggagagccgcggcatcagcgtcaatgtggacgagtgctcgatcggtcagccgctcgatgtggacaagtacgacattttcttcatcggcggcggacaggacttcgagcaggaggtgctgctgcgcgacctcgcctccggcaagggcaaggacatctgcaccgctgttgaggaggagaaggtgtttctcgccatctgcggcggctaccagatgctcggtcagtattacaaaacgtgggacggcgtgcagctcgacttcatcggcgcgatcaacgtgcacaccatcggcgcgaaagagcgcatgatcggcaactacatgtaccgcacaacgcccgagagcagcggctccatcgtggtcggctttgagaatcactcgggcaaaacctacctcggtgaggatgtcgcgccgctcggcatgatgataaaaggctacggcaacaacggcgaggaccagaccgagggcgcacgctacaacaacgtgtttgccacctactcgcacggctccctgctgccgaagaatcccgtgctgtgcgacttcatcctgcagaccgcgctcgaccgccgctacggcaagaccgagccgctcgtaccgctcaatgatactcttgagctgaacgcgcacaattatatggagcagcgtctgagcaaataacctgataaaagttacagaaaaaggcatgatttgaagtcatgccttttctatttgtctctctgcggaaaatatgttaaaatattatcaagagaagagcatgagcagctcccgacagcaaagagaacgaggagacacaccatgaacaggagaatgattgcggcagcactggcatgccttgcctgcacggcaggactgagcgcctgcagcctgaccggcaccggcggcgatacccatcatatagcggtgatcatcaagcacgcgggcgagcattttcagaacgtcatggctggcgcggaagcctgcgccagcgagcacccgaatgtaacgattgacattcagtttccgtcctcggcggacgacagcgcggaacagctggatctgttccggtccgcgcttgacgatgacagcgtagacgcagttgtcatttcgcccatgcagtccgggcagttgtcggcggccgccgaaagtacaaacaagccgatcatcgcactggatacggatttcacctcggacaaaaaactgtcctttgtcggcaccggcaacgaggcggcagccaaatccggcggcttagctgctatgaagaaggcaaagtcgaacggcgcggacaagccgcaggctgtcatcctgaccggcgcacagggcgacgagacgcacgaagcccatctgcgtggctaccgcagcgccgtggagcaggcgggcggcactgtgctcgaggtgcagtactgcgacgcgcagcccgaccgtgcggccgccgcgatggaggctgtcatgcagaagtatccgcagggtgtggacgcgctgctcgttaccagcgatgatatggcgcttgcagccatcaagtgcatctgggataacaacagcgccgcctatcaaaaaaccgttatctgcggctttgacggcaatcaggctgcggtggaagcgctcgaccgcggcgagctgactgtcgatattgcccagcagggctatgaaatgggctacaaagctgtcgaggccgctttggacgcactcgagggcaaatccgtcgaatcggtgatcgactcgggttccgaggtcatcacagcggacaatatcgacgcatacattgccgactgcagggaaaaaggtctttggtcgtagcaaaaagagagagtttcgtttgaaactctctcttttttattcttccgaacagtatatctgctaaaattttcagcatatcgcgcgatagcgcgcatttaatagaatcgcaacgcgattcataaaaaccgggagcatgtatctgcgcagcgcggccgagaagccgcgcaaggatagcgccggtttttataccctaagagggagaaagtttccgtatgggaactttcggacgactttggaacggcctacggtccgttcctcttgtcggccaaaccgtggtttggcgacagcaattaaaagccttctcgatgtaccatctgatagagcagcgcattgacaatggacgcggctacattcgagccgcccttgcggcctcgcgcgatgatatacggcgtgtccccgccgatgaacagctcctttgcctcgaccacgttgacaaatccgaccggcacaccgatgacgagcgcaggcgcgacaatgccttcctcaatcaactcatgcagacggatgagcgcggtcggcgcattgccgatggcgaagatgagcgggccttcaaatttggcggcgtgctccatcgaaacgactgcccgcgtgacaccgcgcgccttagcctcgcttgccacctgctcatccgccatcaggcagatcgcctttccgccgagctttgccagcgtcgccttgctcaccccggagagcgccatattggtatcggtaaccaccgttgcccctgccgcaagcgcggcctttgccttttcgatcacatccggcgaaaacgcgaggctgtccgcgtagtcaaaatccgccgtggtgtgaatgacgcgcttgaccacctcggcgatgcccgccggaaacgtgcgctcgcccagctcggcggtgatgatttcaaacgaccgcttttcaatgtcctgcggcttcatgtatccgttcaaaattcgattccctcccgcgcagcgatgcccttctcaaacgggtgccgctgcattttcatttctgtaatgtagtccgcgtgtgcctgcagcgcttcggacggaccccgtccggtcagtacgacctcgagcgtttccggcttggtctcaaggaattttacgaccgttttctcatccagaaagccgcacgagattgccgcgcagacctcatccagcacgagcagccgcgcgtgctcccgcacggcaaagccggttgccgcatcgaaggtgcgggtgagcgcgtccgctgtctcccgcttctccgcctccgtcatgcggaacgagaacttgccgaccggattggctgccataacggtcacgtcgggcaatttcgccagcacgcggcactcgcccgaagtcccatccttgagaaactgcgcgaacacgaccttgtttccgcggcccgcgcagcgcacggtcagtccgaccgccgccgtggttttgcccttgccgccgccgcagtacaggtgaataagtcctgtcatgcttttccctccattatacggtaaatccactccatatcaagcgattttcgcaccgaatccgccagtttgtcatactgctgctccttgtaggcgtgcgtatcgagtgcttcgccggtcagcgtcacgcccttctttttcgccagtgcctgcgccgtccgcagcgccgcctccggcgcatcgaacacaccgtgcagataagtgccgaaggcgttttccgtctgacagccgtcctcgatttctccttccctgcgaagcaatcgaacgagcggctttgcactcgcgtcgcgcacggtttcgcccatgtgaatctcgtagccctcgaccgccagaccgctcaaatcggacagcacgccgtcaatctccagcagcgtgccgcgcgtctgcgtcgtggtcttgctcgggcggaacaccgtgtcgatcggcagcaggttcatgccgcgcagactgccgccgccctcggtattgtccggatcggagaccgtgcgtcccatcatctgatagccgccgcagatgccgaaaaccggcgtgcctgccgcgtgcgccttgagaatctgcgcctccatgccgctctcgcgcagccaccgcaggtctgccagcgtggacttggtgcccggcaggataatcaggtcggctccggcaagctgcgccggtttgtccgcatacgcgacactcacgccggatacacgcgaaagtgcggaaaaatcggtgaaattggacagtcgcggcaactttacaaccgcaatatttaccagtgcgggagcagcctttgtgtccagacgctcggacaggctgtcctcatcgtcgatgtcaaaatggccgtacggcaccacgccgatgaccggcttgccggtcaaatcctcaagctgcgtcagacccggccgcagaatctccacgtcaccgcggaatttgttgatgatgagaccgcgaatccgcgcctgctcgtcctcctcgagcagcttgaccgtgccgtacagcgacgcgaacacgccgccgcggtcgatgtcgccgaccagcaaaacgggtgcatccaccagcttcgccagacccatatttacaatatcatcctgcttgagattgatctccgccggactgcccgcaccctcgatcacgataatgtcgttctcggcggcaaggctgtcaaatgcgtccttgataatgggcaaaagcgcctttttgcggccccaatactcccgcgcggtgcggtttccctgcgcctcgcccatgatgatgacctgcgagccaacgtcgcttgtcggcttgagcaagatcgggttcatgcgcacatcgggcgcgatgcccgccgcctcggcctgcacgacctgtgcgcggcccatctccctgccgtccgccgtgatgaacgagttgagcgccatgttctgtgacttgaacggcgcaacgcggtagccgtcctgccggaaaatccggcacagggccgcgcaaagcaggcttttgccggcgtttgagcaggtgccctgtatcatgataatttttgccatttgcaaacctcccgcataatggaaaatgtcactgcccttgcgcccgcggcgctgtcaaatccgcacaaagcgcgtaccttcgttttccattatcaatttgattgcgtttagcaagcacttgcttgcttctctcgtttttacggcaacgcgatagtatcccgccgaaagtccgcgataattatcgcagtttcgtatcattatgccgtgctcggcgagtttctcgtgcagtccggtatcgtttaaacggaacagcaggaagttggcctcgcccggaaagactttcagtccgcaggctgcaagtccgtcggataagaattttcgttcctcggcaatgcgtttggcggtttcgatggcccagtccggctcgtttgccgcggcggcggcgcacgcctgtgcgatgaccgacacgttccacggctgtccggcatggtataatttctcaatcagcgccgcatccgccgtcatgcaccagccgaaacgcacaccgggcacggcgtacattttcgtgtacgcgcgcaggataatcagaccgggattggattccagcaggtctttccgtgtgtgccgctctgcgtctgtcagaaagtcattgaaacactcgtctacaaccagttttacgccgttttctgtgcattttcggacgatttcccgcagaagttccggttgggcggttcgcccggtcggattgttcggattacagagatacaccgcatccaaatccggtgaaatctcgtctaaaatgcgctctgtgagcgcaaaaccgtccgtttcccgcagattatgcacccgaatctccgcacctgagagcgtgcgctcgtactccgcaaaggtcggtgcggtgagcagtaccttgcgcggtttcagcaccgccgccaatcggtcgagtacatccgccgcaccgttgccgcagtacagaaaatccggattgacgccttctctcgcaccaatcgcctgccgcgcggcgcggcaaaacgggtcgggatactgcgtgcaattatccacagccctgtgcatggccgcgcgtaccgcgtccggtatgccgaacggattgatgttcgcggacaggtcgagcggcgcgaagccgtggcggtcgatgtaggtttggatgtcgccgccgtggacataattaagcattttttcatcctttcaaatgcgagttttctctcccgcatagcatcctaactttttacgatcaggcggattacacagcacagcaccagcgcaaacacgcttgccgccgtcatcagatcgaccgctgcgagaatatccgtgcggtctacacggcgcatcggatcaccgaaggcggcttttttaacgattttaccgaagtagctggcatcgccgccgagctggatgtgcagcgcgcccgcgcacacagactcggtctgaccggcgttcggactcttgtgtttgctgcggtcacgacggtaaatccggagcgcgtttcggttatcgaggtgcagcatgccggcaccggcgatcatacacagcgcggacagtctggcagggataaagttgaaaaaatcgtccatttttgccgaaaacttgccgaaatactcgtaattatcgttatgatagccgaccatggaatccagcgtgttgaccgccttgtacagcatgccgagcggcgctccgccgatgagcatgaacacgagcggcgagactacaccgtcggtcaggttctcggccacagtttcgacggcagccttgatgacaccctcctcggtcagctctgcggtgtcgcggccgacgtaccacgcgatggccttgcggccctcctcgagcgactgcttgaccgcgccgtagacatgataaccggcgttcgcaaggctttttcgtgcgaaaatcatccagcagagcagcgtttcggcggcaaaaccgagccagaagttcacatgatacagccagcgcaaaaggaaaaacggcacggcaaagctcacgccgcaagtgatgagccagagtacaattccagcgaatgtcagtgacgcaggcgttgtgggaaagatgcggcgcagaactttttcagttcctgagatgagttttcccaccgcacataccggatgcggcaattttttcgggtctccgagcagccagtcgagcgcgaagccgagcagcacggcaagggttatcgtcatggtttttctcctttgatgaattgcggcacgcctgcgatcacgcgcacgactgcgtctgctttctgtgccaaagcacagcacagacgaccaaccgcttcacgccagttttcgtccgcacggtcgatgggaacgatgccgcagccgatctcatcgcaggtgataacgtgtccgcacagcgtatctgcgagcgacagcgggtctttgtcttccttcagcattttccgcacgatttcgtgcagattttcaatcctcggcaggtctgcatacaggttttcggcaacttttcgtttcccctgatatgccccgccaatgatgagcacggtcataaaatcagtcctccaatcgctgctgccgcaagcgtgatcaattccgacagcgagatgcagaatcctgccaggtctccggttacaccgccgaacacgcggcggcttatgtgctcatgcacagcataccacacaacgagcacgataacgagcactttcgccgcagcaagcgcgtgcggcacgcggtatatccacaatccgagaagcaccgcaaacagaacaaattcagcaactaacatgcgcgataccgcgcgtttatcgctgttttccgcaaagatatgtgcaagtccgctgtctttcgcgcacggtgacgcaaccaccttgcggccgcccattgcccgtgcgaaagcaaatcctgtgcatgccagcggaagaagcacaggccggtcgtaaatctgggcaaaacacccgacctcggccagcaggaatgccatcagccagagcggcccgaatgcgccaacgtgcgggtccttgaggatggccagccgcttttcccggtcgccgaacgagcacagcgcgtcgcaggtgtcgcacaggccgtccagatgaatgccgccggacactgccataggaatcagcgctgcgattacagcgtaaaacacgccattcgcaccaaaatatgtgcagaatgcgaaccagaaccactctatcgcaccgatcagcacaccgatgagcggcaggaagccaagtgcccaccgcatggtctgtttttcccagttcacctgcggaacaggtatcgcagagtacattgagaacgcgaccaaaagtccgctgattacacttttcacggctgttttccctcctttgcagacagtaaaattccgcataccgattcatataccgcgtctgctttcccagttaatttctggtgcagttctcccaaaatccgaatatactgcatggtctccggcggatacggcacgccgtccgcaaagatttcgttggaaacgataaccagcgtttcacagtatttttgcagattatccacgcctgcaacaatgctgtcgaacgccgatcctgcgcctgcgccttccggcgcaaacagttcgtttgccagcagattgcccaaatcctcgagcaaaattccgtcgtattgccgagagagcctgagattcgctaaatcaagtgttctctctaccgtagcgaacccctttcccgcacgaagcgcccgatgccgcgcaatccgcgcctctgcagacttgccgaacggctgcatggtcgccagatataatcggctctgtgctttttcacacaccagccgttccgcgtgctccgacttgcccgaagccgctccgccggtcactaaaatcagcattttcgctcccctttctgaattagacttgcaatccgctctgattttcgatacaataattttatccgagtaagttgaggtaagaaaaaatggagctgcattacgatatcaccaaacaggatttcattgattttaatttgaattattacaacaataatgcgattgttcaacgcagtattcgcaccatgagaatcgccactgcggctattgtcattctcggcggcagtgcgctcatgtactggctgcacacgctcacgccggtttccatcgcggtttacgttgcgctcgctgccgtctgcttctggggtacaccgcgctatatgcgtcataaaatgatcaaaaatatcgagaaaattctcagaaacgcaaagaacaagcagctttgcggaccgaaaacgctcacgctgcgtgaaagcgaattcgagctgtccggcgagaacgaagataccgtttaccagtattcggccgttcagcgcaccgcaaccgatgacaagcattattatatttttgttgatgaattctccgcggtcatcgtgccgttctcagcgtttgaaagcgatgcgcaaaagcaggagttctacaacaaaatcaccgcaaatattgcagatgaagccctgaaatgctgaaaatccgaaccgtaagcaccgagttaacgctcggtgctttttgctgcacgcagcattcctgtaaagaatgcaggcagatagcatttatcagcgttacacacaatatttatgcaaagaatttgtgctatctgtcagacaaacaactacttttgcggctgatatgcctccattccaatgtccgcgaagctcaccatttcccgatatggcgccagtgccaagtccaaaagcgccacgccggccgccgcgcctgtcccctccccgaggtgcatgcccgccgtcaggaacggccgcttgccgagtgcatcgagcagcaaaatgctcgccggttcgtccgatctgtgcgctgcaaccataaaatgcacagacagcggacacaatcgcacggcgagaagcgccgccgcacacgaaatcacgccgtccagcacgaccggaatgcgctgcgccgccgcacccagatacagaccgcacaaacccgcgatatccaaaccgccgaccttgtgcagcacgtcgatcgagtcattcgagtcgggtttgtgaagcgacagcgccgcctcgatcactgcgatttttcgctccagaccggccgttgacagacccgctccgcgtcctgtgaccgccgcagcctccgcgccggtgagcgccgccgtgactgccgcgctcgtagtcgtgttgccgatgcccatttcgccgccaatgagcagcgaatatcccttttcggcacacatttccgctattttaatgccgatttcgaccgcttcgagcgcctctttccgcgtcatggcaggctcatgcgcaaggtttgcagttccgcgccgaacggaaaattgcagcactttttcgctctttatcggccgcgcaacaccaatatcgaccgggaacacgtccattccgagctgttttgccatcagacacacggtggactcgccgcggcccatattttccgcgaccgtggctgtcacttcctgaccgcactgcgtcacgccctcggcgaccacgccgttgtccgcgcagaaaacaaccgccgcgcgtctggaaatatccggcaccggctgaccgagaatacccgcaagctgcacaatcgcgtcctgcagaagacccagtccgccgagcggcatggcaatatttgcaaaacgatttcgcgccgccgtcatgcttttctcatccagcggccggatggcagaaatagtctgttcaagtgtcattttccgctcctttctgcgcatttccggacaaaattcgctgcaatttcagttttcgcacggaaatacaaatgcggaaatcctgcatagagcgtgtccgacgcaaagccgcagtcccacgcgcgcccgtttggcttgaccgcacgaaaatctgtgccattatccacagcctgtgcataatggaactcgtgcacaggaaattgtccaccggcttcgcacagcaggttatcactgtttgccgtgagcgtgacatagccgaacggctgcagcctgtgcgtcatgtgcgccgaagtcggcagcacgcctgccattgccgcgccgtcgagcgactgcagcagataaagaaatccgccgcattctgcaactgtcggcaaaccgcttagaatcgctgttttgatagaatctcgcataatttcattctctgaaagctgtttttcatacaattccggatagccgccgccaaggtacagaccgtcgatatgctccggcagccgctcgtctgtgagcggcgaaaacggcacaagctctgcccccagttcacgcagcacatcgaagttatcctcgtaatagaagcagaatgcgcggtcattggctaccgcgatccgcaccggaaaatcggtcacacgagcgagcggcatgtgcgtatcggtcagcggtttcgccgtctgtgctaatgcacacaacgtgtggaggtcaatgccctcctctgccgcatccgcgagccgatcaattttctcacgcaggtcggacagctcgtccgccgtcaccagaccgaggtggcggtcaggtatttcggcctccggaaccggcggcaaaaagccgagcacaggcagtcccgctttctctgcgatttgtttgtaaaacgagtacattcccgccgaaacaccgttcaaaatcactcctgcgagcgtattttccgcaaatgtgcggaacccgtgaatctgtgccgcaagcgacagcgactgccccttaggccgcacgatcagcaccgcaggcgtgccggttgcgcgggccagatgcgccgccgaagccgtatccgtcgtaccggaaacgccgtcgtaaaagcccataacgccctcgatcacgccgagaccgtccggctggatatgccgcgcaagctgactgcgaataccggcctcgtcctcgaaaaacaggtctaaattgcggctcggaacgcccaaaaccgccgtatggaacatcgggtcgatgtagtccggaccgcacttgaacgcgttgagttttacgccgcggcgctgcagcgcccgcagaatcgcggtcgtgaccgtcgtcttgccgcagccgctgccggtgcccgcaagcagcagtcttgatgcattattttgtgtcatttgcggccctcccgaacagaataaacaccggattgttcgcagtcagtatggtgtacgcaccgattggcttgccgcgcgtggctgccagctgtgtgacctcgatgtcagaaaaccccaattctttcaaagccgtctgcgccgcaaacaaggtctcgagcgcaatcgcgttcacgaccacgcggacttccggatttttctccctggcaagtgccagaatctcccgcattttgccgccgctcccgccgacgaacacgcagtccggtgccggaaggttctccagtgcctccggcgcaggtccttcaatgattttcacattgtatccaccgagttttatgcggttttcgtgcaagagcgcgaccgcttccggctttcgctcgacggcgtaaaccgtgccgtcgctggccttgcgcgccagctcgagcgtgaccgcgccggtgcccgcacccacgtcccagaccgtgtcggtcggtcggacagtcaggcggttcaccgacacccaccgaacctcttccttggtcatcggcacctttccgcgcgtgagcatttcatctcgaatcggttcgtttttgttcgccgcacgcgggttttcgatcagcagaaccgctaaatccgggcacgaaagctgcgcgatctctgcggctgtgccgtgcacaatccgctcattttccgcaccgagattttccccgagatgaacgggcagcgcgcccaatcccgcgtccataaggctgctgcaaaccgcctgcgcgttgttctcgccgccggtcagcgcaaatgttgccgcatggtaacttacggcaccgagaatatttcctgtgcgaccgtgcagactcttaaaacacagattttcgtaggaaataccgcattttgcgcacatatactgcatactggacaatcccgacacgagtcttaccccgccgtacggcaggagccgctcgcgcagctttccggccgcgctgaaaaatcccacatcgccggaaaccagcagcgccgtgtgccgggcattgccggaaattgcccgctcagccagctcggagaacgcgcagacctccaccttgggcgacagtgacgcaagccgttttgtcgcgaacaccgcctccgccgtttccaacgcgcgaaccgcttcgccggtcagcgtgtccgccgtgcccatgcctgcgccgatgatggtgaatatgcgctgcactttttccggctgtaatccgagcaaatccgcgagaaatgcctgcatttccgcctgatttttgccgttttccacacgcggacgcgcaatgaccagtacctttgcgccgacctcctcagctgccgcgaccttctccgcaaagccgccggacacgccggtgtccttggtcacgaggatttttgcgccggtctcgcgcagcagcgccgcgttcatcgcctgcgaaaacgggccctgcatggcgatgatgtgcgcgcccgggaagccgagtgcggcgcacttttcgagcaccgacgcggtcggcagcacgcgcgggaacaggcgcgtttggaagtcctgcaccgccgtgtacgcttccagttctttactgcctgtggtgagcaggaccgtgccctcgtgcgcgttcagccagtcaactgcagcggctgtgttcagcacgatttcgcagttctgataaggcagggcaggccgcagaagccgctcgtagcgtgcgcccgatttcgcgcaggccgcccgcagattgtcggtcacagccgccgcgtacggatgtgttgcgtcgatgagcagcgtttccgaggtcaatcgtttttccatctcctgctcatccaaacggccctcgtgaaccgtgattccagccatcggctccattactgctgcgccatactctgttgcaacgaaaacctccgcctgcacgttatttttcgacaaaaaacggcacaaatcatgtccttctgtcgtaccggagaaaatcatcagcttcatacgccgcgataccccctcggcgtgaccatgcggccgtccatcacgcgcgtgcggctgttgccgacaaacacagtggtcagcatatcgacctgtgtatcacgcagctcaccgagcgttgtaagcgtgcagctttcgccttctcggccaatgctgcgcaccagaccgcagacggtttccggcggcacgatctccagcagaatatcgcaggctcggcgcagatggtcggtgcgctttttacttgacggattgtacagcacgatgcagaaatcaccagccgctgcgccgcgcagacgctgctcgatcttgtcccatggcgtgagcaggtcggacaggctgatgcacgcaaagtcgcatgtcagcggcgagccgagcacggcgccgcccgagcaggccgccgtgatgcccggaataacctcgacctcgaggttcggctcgtgctcgcaaagctcgagcagcaggctcgccatgccgtacacacccgcatctcccgaggacacaactgcgaccgttttaccctgttttgccgcctcaaccgccgctttgcagcgcaaaacctcgcgcgtcatgccggattcgatgcgttccttgcccgaaatgaggttctcgatcaaatcaagatacaggccgtagcctgccacgcagtcacatttttccagagcacgcactgcgcgcagcgtcatctgctcctcgccgcccggcccgatgccgatgcaatacagcttcatgcttcaccctcccgttcttcaaatgtcacgcgccagtccggcacggcaatggccgccgtcacgccgttctgcgcgaatttgtgcaagataagtgtgccgttctgtgctgcgcacacagccgcgcgttcgcacacattatcgacgccgacggtctgctgcacgaacgccgaccggctgaattcgccttgtgcgtcctgcagctgctcggtcgtaaaggtacggaacggcagtccgtgtttttcgcaaaacagcagcaaacccggctcattctgcttaatatcaatgctcgccgcgccgcagattgcctgccaaggcagttttgccgatacaagcgccgcctgaactgtctgctcgatggcatccgcgctcgtgcccttgcggcagccaatgccgagatatgcaatccgcggcacgagatgcagcgtgtgtgcaaacggctgtgcgtctgtgcgaaatccaatcgtgaacccgctttccgcgtcttttttgaggtcaatacgggcgggcagcagcccgtctatcggaaaatccgagcgaacgcccacggtttcccctctgagcagcgcaccggatacatatttaatatagtgcggctccaggactgcacagctatgtgctttcgcccaggtgtccacggcgaacacctgccgaccgtcggtcgcggtggtgagcaccggcacagcctgcagaccttccgcaagtgtttttgcaatctcgttggcgccgcccagatgtccggacaggagcggaatcacgaactttccctgctcgtcaatgacgattaccgccggatcataggcttttcccatcaaatacggcgccgctgcgcgtaccgcgattccggtcgcgcccacgaacacgatcaggtcgcaatcgaccatcgcctgctgcgcaaagcgtttaaggctcgtgcccgagagcgacgcatccaccgtccgcgcataccgctcacaccggaaatccggcaggagttttaccgccttttgcacagtctgtgcgccgcacagggtaaaggatacaaattttgcgtgcttcatcggcttgcctcacgaaattcggtcgtaaaggtcgggtcgtacagcttagagcgctcgtacttggtgccgaggaacccgcccaccgtgatgagcgcggtcttggtgatgccctctcgcgcaccggcttcggcgaggtctgcgaccgttgtccgcacgaccttttcgtccggccaggtggccttgtacacgatagccgcaggcgtatccggcgcatatccgcccgcgatcagccgctcggacaggcgcgccagctgacccgccgacaggaagatgaccatggtggctccgtgtgccgcgaacgactcgatctgctccttttcgggcacgggcgtgcggccctccatgcgcgtcaggatgaccgactggctcacgttcggcagtgtgtactcggctttgagtgccgctgccgcgccgcagaacgaagacacgcccggacaaacctcatacgccagaccgagcctgtccagctcgtccatctgctctctgtgcgcaccgtacacgcacgggtcgccggtgtgcagacgcacgaccgttttgcccgctttcgcggcaggcgccatcacggcgatgacctcctcgagcgtcatcttcgcgctgttgtacacctcgcatccgtcctttttatagtccaaaagcgccggattgaccagcgaaccggcgtaaacgatcacatctgcctcgctcagcagacgtgcgccgcgtaccgtgatcaggtcgggcgcccctgagcctgcacccacaaagtagatcattcgctttgctcctttaccaatataatagagaaatagccgctcggctgttccagctcatctaaattttcgatcagccgctgaccgtccatgccgacccgctcgatcagcgccgcgctgccgagttcgccgcgctgccgaagcagttcgcggacctccaatacactctttccggtcttcatcagcaccttgctgccggagagcgcaagcccttcctccgccctgccgtgcgtggccggaatgatgtgcagcatttcgccgtcctcgcacagggcgcggcccatggcagcagccgcggcgcagaaggacggcacgccgggcaccagctcggctgcatagccgcgggcggcaacacgcttgtgtacataccagtatgtggaatataccgtcggatcgccgagcgtgagaaacaccacggtcttgccctcgtcgagcagcgcacagagcgcatctgccgccgcatcgtggctggcatttcgcgcctgcctgtcgtacgtcatcggcatatcgaacagcaggattgacttgtcctgcccgatgtacggcgaagcaatatccagtgcggtctgtctgccgtcggcggacttcggtgcggcgaccgcatcgcactcgcacagcagccggatcgccttggcagtcagcagctccggatcgcccggaccgacgccgactccatataaaatacccttcattgcagtttcaacctctcacagagtgcgcgcgcgcccgctgactcggccagcacgccgtattttccggtaaacatgatgaattccacgcgcgcctgccccttcatgcgcagggcgatgcgggtttccatctccctgccaatgcgcgacaggacgggctgacgcagattcacttcgtccagcagctccacgcacgcgtccaccgagatggcagccatcagtccttcgagtgtttcgcgcggtgcgccgcacagtgccgcatgcgcggtgaaaatctcctgccgtgcgtctgcaaccgacgaatgcgtgttcatcacgcctgcagccatcttgaccagctttccggcgtgcccgaccagcaggatctcgggatagccgcggtacgccgcatggtcgaacgcctcaccgatgaagttggagcacttgaccgcgcgttcaaggtcaaggccgagcgtgtcccgcgcgaaatccgcgccgtagttgcccgggcacaggaacgcaatgcgctgtccctgcgcgtacaggctgtccagctccaatcggatggtgtccacgagcgccttttcgctcatcggctcgacaatgccgctcgtgccgaggatagagatgccgccgacgatgccgaggtgcccgttgtaggtctgggcggcaagcgcctcgccgtccttcaccgaaatggtaacggaaaagccgccgccgtatccgttctgctgtgcggcacggtgcactgcatccgcgatctgctgccgcgggccgggattgatcgccgcttctccgaccggcatcgccagtcccgggcgggtaattcgtccgacgccggcgccgccctctatggtaacgcccttttcgattcggcgcacggaagccgtgatgcggaccccgtttgtgatgtccggatcgtcgcccgcgtccttgcggacggtgcagacagccgcgtttccgctcatatgtgcgtcctcgaccggcaggcagaaggtgatgccgcccggcgtgtgcaggtgaatctccggcggcgcgattccggtcagcagcagcacagccgccgcctgcgaggccgccgccgcgcacgaaccggttgtccagccgcggcgaagcgccttgccgccgcggtaggcggtgagtttttcgtccggcatgcggtgcacctccctgtgaaatgtaatccaatttattatagcatacgcaggcttttatttgaagtgcaaacgcgggatgtcttttccctgccccagctttccggtgtcggaatttttatcattttccgcggcagtgccgctctccctgcgattcttcatgaattcttcatcgcgttgttttagtaggataacaaaaattttttataaattcgcactttaattaccatgttctgtaaaataataaacttttctaagtgcgaggtgaaaaaaagtaaatattttacgcagtatttttgtacaaaaagtctgttcaaatttatcatttttcacaacagttgttgataatattgataaatacgcgagatttttttattcattcatccaaattgcacaaatacatcttgacaaagaatttgaaaagtgataaatttatctcacgaaaggacgaaaggaggctgagcaggaaatgaaaaaggttatctgttcggaacacgcacccgcagccatcggcccgtatgcacaggcaattgcagcaaacggtatcgtatttacttcgggtcagcttccgatcgatcccgcaaccggtgcttttccggaagggatcgcagcacaaaccaagcagtcgctcaccaatgtaaaggcaatccttgctgaggcaggaaccggtatggatcaggtgatcaagactaccgtcttcctgagcgacatgaacaatttcggcgcgatgaacgaggtttacgccaccttcttcggtgaaggcagctatcccgcacgctccgctgtggaggttgcaagacttcccaaggacgctctcgtcgaggttgaggtaaccgctctcctgccgtaaggcaaaccaaaaagaaaagaaaacagcaaaaaaagaaaggtgctgtccgctaagcaaagccggaaccggaaaaccggctttgacaaccggggtacctccaaaacacacaactggaggtaatttattatgagcaagcagtatccgctgaacgtacccgcaccgcatcatttcacttacgcagtccgtgatcttccggaagtaaccgttgagcagcgtgagcgcgctcttcaggctactcattacaacgagttcgcattcccgtccggcatgctgaccgtcgatatgctgtctgactccggtaccactgcaatgaccaatcatcagtgggcaagcctgttcctcggcgacgaggcttacggccgcaacaccggttattacgttctgctcgacaccttccgcgacatcttcgagcgcggcggcgagaagaactggaagaagatcatcgacctcgttcgcaccgattgccgcgacgttgagaagatgatggacgaagtttatctgtgcgagtacgaaggcggcctgttcaatggcggcgcagctcagatggagcgcccgaacgcatttatcatccagcagggccgtgcagctgagtccgttctgatggaaatcgttcgcaacatccttgctaagcgtcacccgggcaagaagttcaccattccgtcgaatggtcacttcgacaccaccgaaggcaacatcaagcagatgggttccattccgcgtaacctgtacaacaagaccctgctgtgggaagtaccggaaggcggccgttacgagaagaacccgttcaagggcaacatggatatcgagaagctggagcagctgattcagagcgtaggtccggagaacgttccgctgatcttcacctgcatcaccaacaacccggtttgcggccaggccgtttccatgggcaacctgaaggaaatcaaccgcgttgcgcataagtacaatatcccgctggtattcgataccgctcgctgggctgagaacgcttacttcatcaagatgaatgaggaaggctacgctgacaagtccatcgctgagatcgctaccgagatgttctcttactgcgacgcattcaccatgtccgctaagaaggacggccacgctaacatgggcggcatgctggcattccgcgataagggcctgttctggaagaacttctccgacttcaacgaagacggcaccgttaagaccgacgttggcgttctgctgaaggttaagcagatctcctgctacggcaacgattcctacggcggcatgtccggccgtgatatcatggctctggcagttggcctgtacgagtcctgcgactttaactacatgaacgagcgtgttgctcagtgtaactacctggcagaaggcttctacgacgctggcgttaagggcgttgtactgccggcaggcggccacgctgtatacatcaacatggatgagttctttgacggcaagcgcggccacgacaccttcgctggtgagggcttcagccttgagctgatccgccgctacggcatccgtgtatccgagctgggcgactactccatggagtatgacctgaagaccccggagcagcaggctgaagtatgtaacgtagttcgcttcgcaatcgaccgcagccgtctgaccaaggagcatctggactatgtaatcgcagctgttaaggctctgtacgaggatcgtgagaacattccgaacatgcgtattgtttggggtcacaatctgccgatgcgtcacttccacgcattcctggagccgtacccgaacgaagagaaataatcccctgttccatcctttcgtcaaaggcgataccgcataattgtataaattgtgcggtattcccgccaatgccgcagcaaaggcgctgcggcattgcataacaggaatttctcctgacctttttataactttataatcagggcgtaacctgtgccgcgtggaaagtgcacaggaaagcaaagaacaaaggcgttctttttgccagaaaactaaacagtttctgcggcaaagagaacgctttttttctatccatttacacattaaaggggtgtaagataatgagtaaagagcctaaaaacttagaacagagagatggtttccagagtaagtggggattcattctggcatgtatcggttctgcggttggtatgggcaacatctggcgtttcccgatcatggtgcagaagtacggcggcatgaccttcctgcttccctatttcatctttgtaattttgatcggcagtaccggcgttatcgaggagttcgctctcggccgccgtgcagctgcaggtccggttggtgcgttcggtatgtgtaccaaggagcgcaccggcaatgaaaaaaccggtaaggcaatcggtgcgatcccgatcatcggtgcattgatgctggcaatcggctacacggtcgttctcggctggatcttcaagtacaccttcatgtccctctccggcagcctgttcagcctcggcacggacatgggcgctatcggcggtacattcggcatgaccgcaccggaggctgagacccttcccgaagccctcaaggcaatggcgtcggccggcttcttcggcatcggcaacggcgtatggcagatcgttgcactggtagtttcccttgccatcatggtaatgggcattgcaggcggcattgagaaggcaaacaagatcatgatgccggttctgttcggtctgttcctcgtactggcaatctacatcggcacgctgcccggcgcatccgaaggctataagtacattctgaccctgaatccggctggtctggctaagcccgacctgtgggtatttgcattcggtcaggcgttcttctccctgtccgttgcaggcaacggctcggtaatctacggttcctacctgtccaagagcgaggatatcccgtcctccgcacgcaacgttgcagtatttgataccatagcagctctgctggcagcagtcgttatcattccggcaatggcagttgttctgggccaaggcatcaacgacgtatccggcggccccggcctgatgttcgtttacctcgtaaacgtattcaacgcaatgcctgccggccgtatcatcggcgcgatcttctacatctgcgtactgttcgcaggcgtatcctccatcgtaaacctgtacgaggcaccgattgccttcctgcaggagcacttcaagttcaagcgtgcagcagccgttggcatcatcggtgtgatcggtctggtcgtttccatcgcaatccagccgtggacctctcagtggatggacgttgtttccatttatatctgcccgctcggcgctgctctggccggcatcatgttcttctgggtactgggcaaggaaaaggcacttgctgctgttaacgaaggcgctaagaagccgatcggcggctggttcttcccgctcggcaagtgggtatacgttatctgtgcagttcttgcactgatcctcggcgttatgtacggtggcattggctaatccctcaagccgtcaccggtctttcaaaagacgttcatggagtttatgaatcgtctgtatccccccttttgtctctgtcccccgtcactgctttgtgacgggggacacacttttctaatccggaatcagcaatcagcaggcagtaatcgctgcatgcaaagcaaaaccccggctttgccgcacttgacaaaaccggggctgctcgggtatactatccccaagggatgctgttcaggcagtcagaccttattcaatcaggatttttagtcactgaccgttcgggcctaatcgagcggtcagtgcgcttttatacagaaaagagacgagccaggcaggctcgtctctttttattttgcatggagaagattcagttaaagtaaacgatatcttccttcgccttttcggcgggttctaccgtgatggcatgcagcaccggaccgggaccgcggtactgcggcagctcctcaacggtgatggacgccgttaccttgacccagtcgcggttatgcagctgatcgcggtcgggatagcggcagaggaagccgaggaaggtgacgtcatccgcgcagcagaccatgccgaaacggccgggcacgaagctgccggcgggcacatccttgccgacgtaggcctgggcaagaaagcggacggtcttgccgtcatacttcatcgggtcgccggtggcgtcgatgtaccagagaccgtagtcctccggctggatgtcgatgatatccgcatccacgtcaaacggcagcggcatattgcgggcgtagtcctcggaattgccgttcacgtcatccagatagattgccgcacgcggattcatcgccttgatgttcttcttgtacagcatgtccttcagctcatccgtgcagcggttgaacacaaccagatccgccgtggtgatatgctcgaacatcatcgggccgatgttgttggaatacagctcaaacgtggtcgcatcgaccgtggtgacgatctggtacagctcccagcgggcaggaaatgcctgcatcagcttttccagcttccacatgccgttgtactcaacaagaatgcggtccggctggtatttctgctccactcgcttgaggatattcggcgtcagacgatcctcggactcgatcggcacaagcgcggtgccgtagtgcagcagccacttctcgtcgtattcctcgatgccttcttcgcacagcagcagcaccgtgcgctcgttctcggtaaagttcgggtccgcgagaatgtcctgaatgaacttggtcttgccgctctccaaaaagccggtaaagacgtataccggaatgggttcgttagccatatctggttacctcacttttcgtttacaccgaacagcgcagcgatgcgctcctcatccagttcggagccgatgacgcacagacggccggtgtaatcggcagtgccgcggcgaatttcgggtgcgcccggaacgtagtcaaagtgcagccactcgccgccgtctgcacacggaacgatgccctttgcacgcagtacggtgccgagcgtaacatcaccgagcgcggtaagtgccgcgttaagctcgtcctcggtgtacttgcgggtcgtttccttaccccaggaggtgaatacctcgtcagcatcgtgatcgtggtcgtgaccgcagcagcagtgaccgtcgtggtcgtgatgatgatggtgctcgtggtcatggtcatggtcgtggtgatggtcatggtcatggcagccgcaggtgcagtgctcatcgtgctcatgatgatgctcgtgctcctcatggtcgtgctcgtggtcgtgctcatgctcatgctcgtgctcatcatggtcgtggtggtgatgatgatgctcgtggtgcggctcgtgcgcgatctcctcgagaacctccgcaacgaggtcgcggctgccttccatggtggagagcagctgctcgccggtcaggtccttccacggagtggtgacgatgcgggcgtgctcattcaggccgcgcagcatggcaacggtctcgtcgaggcgcttctccgggcactcagccgtgcgggacagcaggatggcaccggcatgcgccacctgattctcgaaaaactcaccgaagttcttgaggtacatcttggccttgagcgcgtcaacaacagttacaaagctgttcagctgaacttcgagatgcgcgttctgtaccgcagcgataacgtccgacagcttgccaacgccggacggctcaatcaggatgcggtccggatggtactggtccacaacatcgtgcagcgccttgccgaagtcgccaaccagcgagcagcagatgcagcctgcgttcatctcgtttacaacaatgccggcatccttgaggaagccgccgtcaatgccgatctcaccgaactcgttctcgatcagaacaacctgctcacccttgagcgcatcggccagcagacgcttgatgagggtcgtcttgccggcacccagaaaaccggaaataatatcaattttagtcatgctttgtcgctccatttctatgcacggcacagggattcccaaaccgtactcaaatttttcgaacgcttatattataccacatttatagaaaaaagaaaagttatttagttagcgggcgctaatctttctgactgcgcggagcgtttgagagccgtgacgcaacaaaaccccggccctgtcgcttgactagaccgaggttctgcgggtataatatacccaagggatgttgctaagcaatcagacctttccgtatcatagttaaactaagatgaccgttcgggccctactccgagcggtcatcgtgcttttatacagaattcgcttatagtataagcatatcctgcagaaatttgtcaatcaaccgcctttacaggcgtttttttgtttttttgcacaaaaaatggagaacggaacgcatttcccattctccactttccattctcaatttgtattattctcccatcacctgaaagacaatatcccgcacgcggttgcgggtatcgcactccacaagggtcagattctgccacgggccgatggtgatctcgccattcacgaacgggataacgataaacgggctgagcagcgccgccttgatatgcgacgagccgttatcatcgtgccatgtgtcatggtgatgatagtaaatgacgtttccctgctcatcgcggtagggcgaaaagacgtccatcgccgccttgaggtcatggtagaccatgcccggctcaaactccagcgtggtcaggccggcaacaccgccggtggtaaagccggtaatcgtgccggactgcatgccggtcttgcggcaggcgttctgcaccgctgcgcggaagtcgtcagtaacgtcgatcatgcccatgtgggccttggtgtggtaggttttggtttcggtataaacaggcatttgcgattctcctttagagacactcgagataacggccatacagggtcttattcagctcttccgcatgacgaagcagcgtctgacggctgatatagccgcgcgcgtacgcaatctcctccggacatgcaatgtagcggccggtctcatcctgcacgcggcggacaacctgtgcggattcgagcaggttgtcggcggtaccggcatccagccagacgaaatcccggtcgagcttttcaacgtgcagctgaccgcgtttcatgtactcgatattgacatccgtaatctccagctcgcctcttgccgagggcttgagcccgcgggcgatctccataaccgagttatcgtagaaatacagacccggaatgatatagttagacttcggatagcgcggcttctcctcgatggaaatagcacggccctgaccatcaaactccacaacgccgaacgcacgcgggtcatcgacatagtagccgaacacgcaggcgccggatttctgctgcacagcacggtccagacagtcctgaaaattgggggaatagaagatattatcgcccagaacaaggcaaaccgagtcatccccgatgaactgggagccgatgagcagcgcgtccgcgatgccgcgtgcaacctcctgcacctcgtaggtgatgttgacgccgaagcggccgccggaaccgagcagacggtagaacgggccttcctctccgggcgggatgatgatgagaatatcgcggataccggcctgcaggagcgcagccagcggatagtagatcatcggtttgtcgtataccggcagcagcggtttgcataccggacgtgtcatcgggtacaggcgcgagcccttaccggcggcaagaatgattcctttcattggctattcctctatctatatggttttgtgagattagtatagcacatttcgggcaaataagaaagcaattttccgataaccgctccccaccgaaaatacctcttgacaaatcgaacatttgttcgtattctatcaatcaaagaaatggaggtgttttcatgtatgaaaacgagatgaagtccggatatccggtacattacgacccggattacgcctatgatgacgaaaacatgcccattcccgagcaggagccggacgagcaggcgcttgcgttccagaaggaaatcgaggaacgggaagccttcatgcaggagcacatgaccctgccggacggcacaacagacctgaccaccttcggctggacgagcctgcgcaggctgatgtgcaaggagctgccgtctatccggtacatcgtggacggcctgctgccgcagggactggcaatccttgcctcgccgcccaaatacggcaaaagctggcttgcactggatttatgcatctccgtggcactgggcgagccgtttttcgggcgcaagaccgagccgtgcgacacactctatctggcactggaggattccgagcagcgtctgcagtcgcgcggacagaccgttctcggtgaccgcctgccgcccgagaactgctacatcggcacgctggcggggtcgctcgctgaccgtctgccgcaccagattgaagcctttctgcaccggtggcctaacatcggcttaatcgttatcgacaccttccagaaggtgcgtgtcagcgcacgcgcaggctccaacctgtacgacaaggattacagcgatatgggcattctcaaaaacattgcggacgcgcataatatctgcattctgctcgtacaccatctgcgcaaggcgcccgagccgggcgacccgtttgcccgcattctgggcacacagggcatcaacggtgcgtccgataccaactttgttatggtgcgtgaggaacgctcggacgacatcacccacttttacagcgcaggccgtgatgttatctccgaggatttggagctgcagtttgataagcagacgtgccgctggcatccggtggcgaacaaagctgcgcgtaccgccgaggaacgctaccgcgccgacccgctcgtgcagaccgccgaacggctcgtgcgggagaatcccgcaggatggcagggcaccgcgagcgagcttaccggatgggtgaaggagacgaccggggtgaattttacggcggtgtcactttctaagcaaatgcgtaatttaagagacaatttacttatgtatgataacattgtttataatccgccggaacgtacacacggagcacaacgcacacatgttctgtaccgtgtaaaaaactgtcctaaagcgtcctaaactgttttacacataataatctatctaataatatatatcttctcaacagattaggacggataaggacggtttttccgtagggtgcgacgacctcggcgcaccgcatctaacaattggtacacgttatcccgtgtgggcgaacaatgttcgcccctacggttacgcatctgcatatagtttacaaacggtgcgccgagtcgtcgcaccctacggttacgcatctgcatatggtttacaaacggtgcgccgagtcgcaccctgcgggatacctgcgcaatatatgaaaaaaagagtggaaagcacttcactctccactctttcttattttaattcagcgctgcaatcgactcttccagctttgcgaggtgctcgcgcagcttttcggccttttcgcgctcggctgcaacaaccttctcgggtgccttatcgacaaacttcgggttgttcagcttcttcataacgaagtcgatgtcggcctcgaccttgctcttctccttgccgagacgagcccgctcagcctcgaagtcgatgaggtcgcccatcggcatatagatctgtgcgtcgccggtgactacggatgccatcttggcagcgtccgccggaaccgcgtcgatgagttcaatctcggaagcgtaagccagcttcgggaagaagcctgcgcctgcggagaaggtgtctttcttctcggtcaggatgagcaccttggccttcttggagggcggtacgttcatctcggcacggcggttgcggatggcgcggacagcgtccatcaggctctccatctgtgcctcctccgcggcaaagtgcagctcgtccttgtattccggccatgcggataccataacggacgggccctcatgcggcagcgcctgccagatggtctcggtgatgaacggcatgaacgggtgcagcagctgcattgcgccgctcagcacatagcacagcaccttctgtacgttctcgtcgccggtctgcagacgggtctttgcaatttcgatataccagtcgcagaagttctcccagatgaagtcgttcagcttggcagccgccagacccagctcgtactggtcgatgttgcgggtaacgtcggctaccagcgtgttgaacttgctgataatccacttgtcctcgatggcaaggtcgctcggcagctcgactgccttgtccttgtcgatggtcaggttcatctggataaagcgggatgcgttccagatcttgttgcagaagttgcgggacgcctgtacgcgctcgtccgagaaacgcatgtcgtttccggggctgttgccggttgcgagggtgaagcgcagcgcgtccgcgccgtactggtcgataacctcgagcgggtcgatgccgttgccgagcgacttggacatcttgcggccctgtgcatcgcgcaccagaccgtggatataaaccgtcttgaacggggtctcgcccatgtgctccacaccggagaagatcatgcgggcaacccagaagaagataatatcatagccggtaacgagcgtagaggtcgggtagaaatagtcaagctccttggtcttatccggccagccgagcgtggagaacggccacagcgcagaggagaaccaggtatcgagaacgtcctcttcctgacggatgttcttgctgccgcacttcgggcaggtgcatacatcggtcttggagacggtcatctcaccgcagtcgtcgcagtagaacgccggaatgcggtgaccccaccacagctgacgggagatacaccagtcgtgtacgttttccatccagcgcaggtaggtcttggagaaacggtcgggcacgaacttggtcttgccctcgtttacaacgtccatagcgggctttgcgagcggcgccatcttgacgaaccactgcgccgaggtcatcggctcaacggtcgtaccgcagcggtagcaggtgccgacattgtgctcgtggtcttcgatcttgaccagccagccgccttcctcgaggtcctttacaaccgccttgcggcactcgtagcggtccataccctcgtacttgccgccgtttgcgttgacggtcgcgtcctcgttgaacacgagaatctgctcgaggttgtggcgctgacccatctcgaagtcgttcgggtcgtggcacggcgtaaccttgacgcagccggtgccgaactccatgtcaacgtactcgtcaccgaagatcgggatctcgcggttcatgatcgggaggatgcaggtcttgccgatcaggtgcttgtagcgctcgtcgttcgggttgacggcaacgccggtatcgcccatgaaggtctccggacgggtggtcgcaacgaccagatcgcccgagccgtctgcgagcggatagcggatgtgccacagcttgcccggctgggtttcgtactcaacctcagcatcggacagggcggtcgcgcaatgcgggcaccagttgatgatgcggtggcccttgtagatgaggcccttgttgtacaggtttacgaatacctcgcggacagccttggagcagccctcgtccatggtgaagcgctcgcggtcccagtcgcaggaggtgccgagcttcttgagctggctgatgatgcggttgccgaacttgtccttccacgcccatacgcgcttgaggaactcctcgcggccgaggtcgtaacgggtcaggccctcctccttgcggaggttctcctctactttaatctgggttgcaataccggcgtggtcggtgcccggcatccacagcgcctcgtagccctgcatgcgcttagtgcggatgaggatatcctgcagggtctcgtcgaatgcgtggcccatgtgcagctggccggtaacattcggaggcggaataacgatggtgtacggtttcttgtccggattgacctcggcgtggaagaagccggaatcgacccagaacttgtacagcttgtcctcgaccgatttcgggtcgtaggtcttaggcagttcgctcattgatctatctccttcaatttgatttacgatataaatgcgggatacttctgtgcaaacaaaaaagagcatactcatcccgacaacaggacgaagtatgctccgtggtaccacctgaattcgcgtaaagacgcgcactcgttgccccgtaacgcgggttagacggaacagcttaacgaaaattcggctgttctgctccaaagcgaccttcttcttccccgccgaggtgcttgcaccgaccgcaccctctctaaacgcgcaaaggaaaaatactcctctttttcatggcatttgtgtattaactttaatattatagctgttaaatccgggtttgtcaagggatatgacgcagttgacagcaacttgcctatacgatacatgccagcgaatatactaacagataaatacaagctcacgctatcccgtagggtgcgccgactcggcgcaccgtttgtaaaccgcagggcaaatttcacagcaacggaatacattaacgacagcgtatgccacggactataatccggtgatattcgctggaatgcggtgcgccgaggtcggcgcaccctacggtcaggcgatttacaacttattacctgttgctgtaatattcgtcctctgcccatctgcgcggattatccaaaatataattgtatttcacggcgtaatccgtatcatcccgaataatatggtcgtaaaacgaccgctgccacaaattgcgtccggcatcctgattggaaaaccgtttcaataccgcaattatgcgtggcaccaattccgtagggcgcgacgacctcggcgcgccatcatcacgcaaaaccgaaatcaacatatgaacatggtttggcatgataacataggaatcaatcgacacatatggatatgccccaggaatcgttcggatataatgttcaacaattttaccgatgaccgataaccgcagggacggcgcgccgaggtcgtcgcgccctacggttgacagcgtgcattgccgttgataggtgcagagcgtcacaaaatagacgccctgctttccgtaatcatactttggcagccgagccgatctcctcgtctccatcaggaaagtctccgcttaaactcctcatacccaaacatacgcacaacctcatccgtgccgtcggcgcgccggatggcgatcagcggcagcggcataccgttaaacgtattggtcttgaccatggtgtagagcgccatgtcctcgaacacgacctgctcaccggcgccgagcgccacatcgaacgaatactcgccgatgacatcgcctgcgaggcaggagcggccggtcagcagataggtgaacgcctttttgcccggctcgccgccgcggtacaccggcggacggtacggcacctcgagcacgtccggcatgtggcacgccgccgaggtatccaggatcgcaatgtccttatggttgtgcatcacctcgagcacggtggagaccagatagcctgcattcagcacaacggcctcgcccggctccagataaacctgcaccttgtattttttctgcagataatcaatgcagtgcaccagcgtttccacatcataatccgcacgggtgatgtggtggccgccgccgaggttgatccatttcaggccgtccatatactggccgaaattctgctcaaatgcagcgacagtccgcaccagatcgtccgaattctgctcgcagagcgtgtggaagtggaagccctcaatgccgtcgagcagctccggctggaaattctctatcgtaatgccgaggcgcgaatccggaccgcacgggtcatacatcgcgtggtcgctcggctgcgtggagcactccggattgagccgcaggccgcagctcttccctgccgcgcgggcaaggctgccgtaggccttccactgcgtgaatgagttgaacacaatgtggtcggcgtactccagaatctcgcggaactcgccctccgcgtaggccggcgcgtagacatgggtctcgccgccgaattcctcatgaccgagccgtgcctcgtacagaccggaggccgttgtgcccgccagatactcccgaatcagcgggtacacggaaaacatcgagaacgccttctgcgccagcaggatcttcgcaccggtgcgtctggcaacgtcccgcaggacggccagattctgcaccagacggttttcatcgagcaggtagcagggcgtaggaagctcagtaaatttcatatcagtccaccagcaccggcttgtcgttaatctgccacggcagaccccacttgttcagcgcctccatgtacggatcgggatcaaactcctcgaccgtgtatacgccgggcttgttccacttgccggtcagcagcatcgccgcgccgatcatcgccggaacgccggtggtgtagctgatggcctgcgagccgacctcgcggtagcactcctcgtggtcgcagacgttgtagatataggcggtcttttccttgccgtccttcttgccggtgaagatgcagccgatgttggtcttgcccttggtgcgcggaccgagcgttgccggatcgggcagcagcgccttgaggaactggatcggcacgatctggtggccctcaaactcgatcggggtggtagacagcatgccgacgttctccagacagttcatatgggtcagataggactgaccgaaggtcatgaagaagcggatgcgctgcacgcccggaatattcttcgccagggactcgatctcctcgtggtggagcaggtacatgtccttgtggccgacctgatcgaagtcgtactcgcgcttgatgctcatcgccggaatttcaacccagtgaccgttctcccagtacgagccgggcgcggatacctcacgcagattgatctccgggttgaagttggtcgcaaacggatagccgtggtcgccgccgttgcagtccaggatgtcgatggtgtcgatttcatcgaacaggtgcttctgtgcgtaagcgcagtacgcctgcgttacgcccgggtcaaagccggagccgagcagagcggtcagaccggcgtcctcaaactttttcttgtatgcccactgccaggagtagtcgaagtacgcggtaaagccctcgtccttgcagcgcttctcgtaaatggcgcgccactccggatcgtcggtgtcctccggctcgtagttggcagtatccatgtagtttacgccgcacttgaggcacgcatccatgatggtcaggtcctgatacggcagcgcaatgttcatcacgatgtccggcttgtactcgtcgatgagcgcgcacagctcgtccacgttgtccgcatccaccttggcggtacggatcttggttgcggtcgtaccgtccagcttctccttgatggcatcgcacttgctcttggtgcgggatgcgatcataatctcctcaaaaacgtcgctgttctggcagcacttgtggataactacgccggctacaccgccgcagccgatgatcaatgctcttcccattgttaattcctcctcatttttaactgtatatataatttagatttattgaatggtctttatttgttaaactgccgcttgagaagcgaacggaactgcgccgcacccgcggcgggggcaaaaagggtagacacctacggtttctaccctctttgaacacccgtttcccttgttgggatagcttgggtgcagacggtagactgcgtaagcaggaaaaggggaacggcagtcgggttactcttgcgtgattttcgcaaaatattcgcagtccacagacagcgtactgctacacatgcgggttaatcaacgcagggcgcggcatagcagtgccgcgcgattctttagcgcgttatgatggacagggtctgcgaggataaatgctactaaatagatagattcgtaggtgctgtccgtaacctccggactaacgaattgcgcaacacgggtatgttgcgcctgctggaagtagccgacctgtgtagcagtaatgtatctgacactgcgaacaggttgagaaagacacggaagaaaaaatcctctgccgttcccccatttcgcagcggtcacatgtcggcaatctgcgccagaccctccaagggaaaggggtgattcacaagagggtggaaaccgtaggtgtctaccctcttgtgcgcccgcgcggcgtcagcgcactccccgctgaggttcagcgaaaacctccccgcccgttaggggcgaacacgctcacgcagttcgcgcgccccgctcagccggtgcagagaaaaggctgccgcccggaaggggcgaacccgcctgccaagcggatacccaatcaaacccatagtgattttctaacgattacgttattcttccaccttttccagcagcttctgcacataattcggcagatagaacgcgcccttatgcagattggtattgtagtatctggtttccagtcccagactgttccaccagtccggattcagatcgcgcaccggatgcacgccgcgggacgaaaagccgaacagccagtgtccggacggatacgtcgggatatgtgcctgaaacagacggctcagctcaaacgagtgcacgatattgcggtgcgctctctggcacgccagcgcatcgcccttgtagaacgggctttcgtgctgattgacgagcacgccgtgctccttgagcgccttgtagcagttgccgtaaaattccatcgtgaacaggccctcgcccgggccgaacgggtcggtcgagtcgatgatgataaggtcgtactcgtcctcaatccggcggatatactttaatccgtcctgatagagaatgtgcacgcgcgggtcgtcgagcgaacatgccacaccgggcaggtactccttgcagaccgcgacaacgcgctcgtcgatctccacaaggtcgatatgctcgatgtgctgatagcggcacagctcgcgaacacagccgccgtcaccgccgccgatgacgagcacctttttgatcttctcgccgagcacggccatcggcacatgcaccatcatttcatgatagatgaactcgtcccgctcggtcagcatcatgtagccgtcaagcgtgagaaaccgaccgaactcctcgcattcaaacacgtcgatgcgctgaaaatcgctctgttcggtgtaaagctgacggtctacctgtatctgcagcccaaccgtcggcgtgtgcatttcagtaaaggtaagttgcatgagtgaaacgctccttttattccgggctgacaacgccgcggatgacctgcaggttgttcacctcggggtcctcggtgccgagcagcatgcagttcttttccttggcgtagcgaatataatcaagaatatcgcgggtgatacgctcaccgggcgcgaggatcgggatgccgggcggatagcacatgacaaactccgcgcagatgcgtccgaccgactcctcgagcggcatggccttcttgtccgcgtagaacgcctcctgcgggccggcgaccacctgcggcgagatgtactcctgccgcatgagcgtcgccttgtcacgcttgtagcggcggcgaatgtccgcgagagcggctaccagacgttcgaggtcgcgctcacgatcgcccaccgaaacataggcgagcagattgccgagatcgccgaactcggtctgaatatcgtaaaagtcgcgcagaatgtcgtacacctcgatgcccgccagaccaacatccagcgtgtttaccgccagcttggtcgtgtcgaagtcatatactgtgtcgccgttaatcagctcgctgccgtaggcgtagtagtcaccgagggcgttgatctcctcgcgggcgtaggtcgtcaggtcaacgacttttcggaaaatcttcttgccgtgcagtgcaaggttcttgcgcgaaatatccaggctgaccatcagcaggtacgaacccgaggtcgtctgggtcaggttgatgatctgacgaacgtgctccgcgttcatggacggaccgcacagcagaaagctggactgcgtgagcgagccgcccgacttgtgcatggaaacggatgctaaatccgcgcccgccgccatcgcggagaccggcatattttcaccgaagtagaaatgcgtgccgtgcgcctcatcggccagcaccttcatgcctgccgcgtgcgcgagccttacgatttcccgaatgttcgagcagatgccgtagtaggtcgggttgttgacgagcaccgcctttgcggacgggtgcttctcaatggccgcctttacgtctgcgaccgacatgccgagcgaaatgcccagccggtcattcatctgcgggttgacataaaccggaatcgcaccggtcagcacgagtgcgttgatgacgctgcggtgtacgttgcgcggcagaatgatctcgtcgccgcgtttgaccaccgacagaatcatcgcctgtacgctgctcgtcgtgccgcccaccatcaggaaggcgtgcgccgcaccgaacgcatcggcggccagctcctcggcctcgcggataacgctggtcgggtggcacagattgtcgagcggcttcatcgagttgacgtccaccgtcatgcactgctgaccgaggaatttcgttaattccggtgagccgcgtccgcgcttgtggccgggtacatcgaacggcacaatgcgcatgtctttgaagttttcgagcgcctccatgattggcgcacgggattgatccataaaaatgccttctttcggcagaaaatgatatgctgcgctttcgcgcgcagcgacgcgcaaattttattgtgagacaaatccgaacatcgttcggtttgtctttctcgattgaaaatgtattttcaatcgaaatcagtagatgttcttccccgagaaaatctcaatcatctctcgtctgaggtcggagtgaatcttgagtctggtcttgggcggcagctcatagatgtcggtgttgaacaggtagttctggagatcgatctccttgagcagcattctcgtgtggaacagattggactggtacacgttaatgtcgtaggcatcgtaccgctcgagcgttttcgggtcgataaagtcctgaatagacgtcatatggtgatccatgaacagctttttgccctcgatatcgcgggtaaagccgcgcacgcggtagtccatggtgatgatatccgaatcgaacgagccgatgaggtaatcgagtgtagacagcggcgtgatctcaccgcaggtggcaacgtcaatatccacgcggaaggtggcaaggcaagtatccggatggtactccggataggtatgcacggtaacgtggctcttgtcgaggtgcgcgacgatggtatccggctcaagggccggcttcatgtgctcctccgcgatgagaaaggttaccgaggcgccctgcgggtcataatcctgcttggaaatgtgcagcacatgcgcaccgatcatctcggttacccgctcgagaatgccggtcagtcgttcggagttgtactgctggtcgatatatttgatgtaatcacgctgttcgcgctcggtctttgcatagcagacatcataaatgttgaaggacagcgccttggtcaggttgttgaacccgtaaagtttgagcttgttctgcatttcatatcctcacaataccaaaaaatccccaggcgaaaggggtacacacggtacgctttcacttgaggatgatcgttctctttttgcagatgcttctgcacattccgtaggttttatggaagaggaaagagtctatatagcaagaatcgttacttttaggcaataccgcataatgaagcaagagcgatttgcgagtaaattttgtgctctgataaggcgtggttttgcggcaatacttgctgtattgcaaaaaatcacaacgaaatcagggtgcaaaatttccgcaaagcgccgcagtcttaattgtacggtgttgcctttgtactcttattgatcgtttcacaagtgtgatgcgcccgcggcacacggcttttagtcagccaacttataaaattcaataaggcaacaaagttgccagtttcggcatttgacccggctgtccgtatggccttagcaccgttttcgcgcagaaaccgggcggtcaaagaaattctgctgaaaggcttcgcctctccgagtaacttttattatacccgagcatggatacaaatgcaagattttattgcggattttacagatgttgtgccgaaattttcccgggcagcatcatataattagacaagcgcgatttacgagcaaattttatgcactgatagcgccacagtcctgattgtatgatgttgcccttgtacatagaaagtttacagtctttgttttgaaaaatcgcgtaaaacgtagtacaatggaaaaagcaagacgatgtaattttgaaaagacaaggtgaatcatggcacgcaaaaagaaaagcaagggacttcaggtcagcctgatgctgacggtcggactgatgatcgtgtcgtttgcggcgggcatgctgacacagaagattgtgttccgcaagccgcagaccgacgccggtctgacctacattgaggatattccggtgatgaccgactttcttcccgagggcacacgcgcccgtccgggacagaagcgcgagatcaggtatctcgtcatccacgagaccgacaacaccggcaccggcgcaaatgcggccgcgcacaactcgttcatccaccagaacgccaacgccgaggagggcattgtttcgtggcactacacggtggacgatcacgagatctaccaccatctgccggatgatgagactgcctatcacgcaggcgacggcatggagaagaacggcggcaacatgaacggcatcggcattgaaatgtgcgtcaactcggacggcaactacgaacagacgctcatcaacaccgaaaagctgtgtgcgcggctgctgatcgagtatgacctgaacccgtccaaggcactgaaaaagcatcaggacttttcgggcaaaatctgtccgtccaccctcatcaacagcggccgctgggacgagttctgcagcgcggtaaccgcaaaatacaaggagctgaaggccgacgaagcggcaaaagcatcataagtatccggttagcagtatgcaaccatgtgcaaaaaccgtggaaaatcaaagggcgatttgtcgtaaatcgctctttctttttatcctctgatatggtatacttcaaatcgtacgctgtaaaaaaactgaaaaatttaagcgtaccgtaaatcctacttaaaatttatcacattgtgaaggagtgaactgaaatgatcgttgtactcaaacgaaacagcgacaaggaacatgtcgaaaaactgatgcagcatttcacggatatggggctgcggatcaactattcccagggtgcggatacacttatcctcggcctaatgggcgacacgacccggctcgatgaaggggacattatggcgtatgacgtggtcgagcgtgtacagcgcgtgaccgagccgttcaaggccgtcaaccgcaaattccaccccgaggacacgatcatcgaggttgcgggccgcaagatcggcgccggctacttcaatgttatggcaggtccgtgctcggtcgagaacgaggcgcagatcgtcgagtgtgccgagcgcgttaaggctgccggcgcctccttcctgcgcggcggcgcattcaagccgcgtacctccccgtactcgttccagggtctggaggccgagggtctcaagctactgctcgaggcaaagcgtcagaccggtctgccgatcgtcaccgagatcatgagcgaaaagcatctcgacctgttcgcagatgtagatatcatccagcttggcgcccgcaacatgcagaacttcatgctgctcaaggagctgggccgctcgaacaagccgatcctcctcaagcgcggtctgtccgccaccatggaggagtttctcatggctgccgagtacattttcgcaggcggcaataccaatgttatcctgtgcgagcgcggcatccgtacctttgagaagctgatccgcaataatctggatatctccgctgttccgctggttaagatgttcagccacctgccgatcatcatcgacccgtcccacgcagcaggccgccgtgatatggtgcagccgctgtcccgcgcagccatcgctgccggtgccgacggcctgatcatcgaggcgcataacgatcccgcacacgccctctgcgacggtgcacagtcgctcgacctcaaccagttcgataccgtcatgaaggacatcaagcgccgcgccgagtttgaaggccgcgtgatgatgccgtaaatgcaaataaaaagacctctccaagtaaggagaggtctttttatttgcaatggagaattgagaatggaaaattgaaaattaaggaacggcgcggagcgccgtattttaattgtcgcgctgtgcgcggacacattcattctccatcttccattctccattttcaattactgcgccagctccgtcagagcaccaaacgtatatcctgcctcctcccacttcgtcagcagttcatcgagaatcctcgcattggtctcactggtggaatgcagcagcacgatggctccgttatgaatcctcggcagcagcttggagaatgcctgctcatcggtcggctggttatccgtataccagtccacatacgcgagcgaccagaaaaccgtggtataccccagctcctgcgcctgccggagattctcctcgctgaacttgccctgcggcggacgataaaatttctgcatcggctgaccggtcagcgcggtgtatttctcctcgagaccgttcagctccgccgcaaacgcgctcttatccgcaatgccggacatatccggatggtgcagcgtatggttgcccacgatatgcccctccgctgtcatgcgctttacgagttccggcgcggtgtcgatgaagttgcccaccacgaaaaagcaggcaggcgcgttatgctttttgagcgcatccagaatagcaggcgtgcagccgttctcgtagcccgcgtcaaacgtcaggtagatggtctttcggctcgtgtcaccgacgtaaaacgcgttgtactgccgcagttcctcggcggagacattgccgaccggcggctgaccctcggtttggaacgacaatccccagtcgctgacagacgcgggaaccgcctgttcggcggctgtcggctcagcattttcgcgcggaaacaggataaaaaccgtggtcagaaccgcaaaaacgccaagtcctacaccaattcggtgcagacccgtgcgtgtgatcgtgataaacatagcagtgccctcccttgctctaccctatgcgcccgcatggacagtatgacggtttttgcccgccaatttgcgccaaactgcggatagacaaatcctaccgttttcctgtatactggtagtaacacctatgtgagggggcacaatatgaaaaagagaaaccgttttgccgctgccgcactcgcagcgctgctgctcgccggctcggcgccgagcgcgctcgcactggatgccacaccgccgatgtatcagcagtttgggtatgacagcgcggaggattttacccgcagctatctcggcaatttcgttcatttcgattacgatactgccagcgatatgttccgccggtatgtacagcagctgcacgccgatccatcgctcggattttcctatttcggtctggaagatatggacatgctgtaccgctatatcgactacggccagtggaaagatatggacgactactgccgtcaggccgcaagagaaatgatacagaccgccgattaccggtccgagcagcttgcggtgcagctgaacggtcaggccgtcaaattcccggacgcccagccggagaaggccaacaaccgtaccatggttcccttccgcgcgattgccgaggcgctcggcgctgaggtggactacaacgcaggcgcaatcaccgctaagaagaacggacagacgcttgctttctcgctcggcggcaagcagctaaccataaccgatgacagcaccggcaaggttatcaagaccaccgctgttgattccgcaccgtacaagaagaagggccgcacttatgttccggtacgctttttcgcggaaggcttcggccttaccgtgcagtgggagaacagtgtgcaaaccgctgttttgtatgaccgcgatgcactgattgcagacattgacagtcactttactgtgctcaaccagtggctcaaagcacagccgtcctacggtcagaatgcaaaggcactgagcagcaccatcaatgtttcgactgactacactctgtatgattccatcgcaggagacaagtcctatcgcgcaagtgcaaaaatcaacgcactgaccgatgaaaatgccgcagaagtccatctatccgctgatttgagcgatcttcccagtgaatattatccgaattattcctctatcccctttgttacggatgattcgtttgagtggtccatcttccgcacactgcgcagttctgacaagagcacgctcaaaaatctgcaagttgatttgtgcggcagtgactccggtgccggctgcttttacatgcgcagtcctgccctgtcggagatgtaccgcggcacggaaaaggaccgtccagaagaacgcaccgccatgaaaaacggtgcatgggtcaatgttgcaacgatggacaccgtattcggcgcaaccgattttgccgaacgctggtccgaactggcacagggcaaggtgaatacagtcggtgaatccatcgtcatcaacagcgaaaaaaacacctatgggtacgaatggtctaaactctttgccgatgcctacgaggaatgccgcaactgggaagcacttgcaggcgacagtctgttcacgcgcagcggttcgcgttataccgccaatatggatctgcgggatatgctcggcagcgatcctgatacttcaaccagcacaataaagtatacgctggatacgtcgaacggttcgatctccggttctacatcgagcagctataccaactggtatacgcagtctattacgacgattgaattctccggcaagctgcgcagtctcagctttacgcgcaccgaacaggttaaaaacaagagcaagctggtgcgcaaaagcacacttaccgcgtctccgacagataccgcaccgaccgctaatccgcccaagggcagcaaaatcattttgtgggatacggaaagcacctattatgatgaggacggtaacgaaatcaccgatatgtctgattttctttcgacattcctataaacacaaaaagagcagatgccaagcatctgctctttttctatccaattcaggaatttagccgcgcagctgagcgccgaactcggtctcgagcgccgagatagcggcacgcattgccttgtcgcactcctcatcggtgagggtacggtcgggtgcgcgcagggacagcgaataagccacggacttcttgccctccgggatgcccttgcccttgtaaacgtcgaacagcttgaccgactcgagcagcttgcctgctgccttctcaacagcggcctgcatggaggctgccggaacggcatcgtcaaccagaaccgcgatatcgcgggtggaagccgggaacttgggcagcggatgatagagcttctccgggtcgatggcagccagaagtgcgtccatctgcagctcggcagcgagcacctcgccggacagaccgtagcgtgcggcaacagtcggatgaatggtgccgaatacgccgatttccttgccgtcgatcagcaccttggcgcagcggcccggatgataggacggattggacttttcaggagcgaaggatgcgcccttgatgttcagctcacgcagcagcgcctcgatggcgcccttgaactggaagaacgacaggcggccgtagctgccgagggtcaggatcttctcctcgtgcggcagaacgtccgggtcagccttgccatccttgacggtcggggtgtagatggtgcccagctcgtacagcgaagcggtcgggttgcggtgcgcgtggttgtgcgccagattatccagcatggacggcagcacggtggtgcgcattacgctgaaatcctcaccaagcgggttgaggatggtggtggagatacggcgcgggtcgttctcgtcccagccgatcatgtcgtagaacttcggggagatgaacgaatggctcatggactcgtcaaagcctgcctcgcggcaaaccagagcggcagcgcgctccgcctgctgagacggcgtgaactcaccctgtaccatctcgcctgcgtacagcgtggtcgggatcttgtcgtagccgtacatgcgggcaacctcctcagccacgtcgcacatgcggttgatgtcggtgcggaagaacggcacaacgacctcgttattctcgatcttgaagtccagcttctcgagcaactttacctgctcctcagcggacagctccagaccgagcagggcgttcatcttgtccggctcgaacggcagacgcttgtggttcgggtcggagttgtcaacgtcgataatgccgtcgatgacctcgcctgcgcccagctgctccaccagctcgcacgcacggttgaccgcatcgagggtcatgcgcgggtcaaggcccttctcaaagcggccggaggcctcggtacgcatgccgagcgcctttgcggtgatacgaacggtagcgccgtggaagtttgcggactcgaaaacgacggtcttggtgtcgtccataatctcggagtttgcgccgcccataacgcctgcaacagcaaccggcttgtcgttgtcgcagatggcgagcatcttgtcgctcaggtcgtgatccacgccgtccagagtctggatggactcaccgttgcgggcacggcggacaacaatgcggccatcggacaggcacttgtagtcgaacgcatgcatcggctggccgtactcgagcataacatagttggtgatatcaacgatgttgttgatcggacgaacgccgcaggcgtgcagacgctcgcgcatccacgccggagacggctcgatcttgatattcttgacaatgcgggcggtgtagcgcgggcacaggtcggtgtccttgacctcgacggacatatacttattgatgtcgtcgcccacgcccttgacctccggggtcttgacgctgaacggacggtcgaaggtagccgcagtctcgcgggccagaccgatcacgctcaggcagtccgggcggttggacgtaatctcaaaatcggaaacccagtcgtccagaccgagtaccttcttgatgtcctcgccgaccggcgtgccggccggcagaaacaggatgccgttctcgcacgcatacggtacgcagccgtgggacagacccagctcctggaacgagcacatcatgccgttggacggcacgccgcgcagcttgcccttggtgatcttcacgccgcccggcagggtggacttgtgcaggcagaccgggcagatctcgccaacggacgcaggcgttacattgggtgcgccggtgacgatctgcaccggctcttccttgccgacatcaagctggcagatcttcagatggtcggaatccgggtgatcaacaacctcgaggatcttgccggtcacaacgttgtcgatctccgcgccgaggtagtaaacctcctcgaccttggagccggacatagtcagcttggcatcatactccttcggggtgatgccgttcatatcggtataatccgaaagccaggataatggcagtttcattgataggaacactccttttggtgttattgttgtccgtagggcgcgacgactcggcgcgccgtatttgccgcctgcatatacttacgagcggcgcgccggggtcgtcgcgccctacgataatacgtatcgcttgtaacatgcgggagagtgcggcgggatgaggtcatcccgccctacgggtgcagatttagaactggtgcaggaatcgaacgtcgttctcatagaacagacggatatcgtcgatcttgaagcggcccataaccatacgctccagaccgatgccgaaggcgtagccggagtattcattcgggtcgatgccgctcatctcaagcaccttggggtgaaccatgccgcagccgaggatctcgatccagccctcgcccttgcagagcgggcagccttcaccgtggcagcggtagcactggatatccatctccgcagacggctcggtgaacgggaagtgatgcggacggaaacgaacaaccgtgtcctcgccgtacagcttctttgcgaacagctcgagaatgcccttcaggtcgctcatgcggatgcccttatcgacaaccagaccctcgatctgatggaacagcggggaatgggtggcatcaacagcatccgaacggtaaacacggcccggcgcgataatgcggatcggcggcttgcgcttttccatcgtgcggacctgcatcggagaggtctgcgtgcggagcacaacattatccgaaatatagaaggtatcctgcgtgtcgcgtgccggatggtccttcggaatgttcagcgcctcaaagttgtagtggtccagctcaacctccgggccctctgcgatggagaagcccagaccgaggaaaatttccttgaactcgtcgagcacgatgttcagcggatgcttcttgccgatgacaacgtcctcacccggcagggtaacgtcgatggtctccgcctccagcttcttctcgagcgcagcctgctcgatcagcttcttctgcttgtcaatgatggtttcgatctccgcacgaacgtcgttgatcagctgaccaacaaccggacgctcctctgcggcaacgtccttcatgcccttgagcagcgcggtcagctcaccctttttgccgaggaacttgacgcgggcttcgtccagcgcgcgcgaatccttcgcggcagcgagctgctccttcgcggtctgcaaaatgccttgcagcttttctttcataccaattctcctttggaatgtgattttgtgatagagtgagggcggatagttcgtagggcgtgacgacctcggcacgccgtctgaaatcatcagctgccgttcgatgcggcgcgccgagtcgtcgcgccctacgggtatcatccattacagtggtaataaaaaacgccttccgtccccgtaaaatagggacgaaaggcgtaaaacttccgtggtaccaccctgattcccgaaaaaatcgggcactcattgaacgccggtaacggagcgttacttcgccggcgcctactgcatctattcagcaccggtgctcacaggggaacttcgcgccatacctcgataaacggcttgcagccatgggaccgttctctctgagaaagaggaacacagcgttacttttcctgctcatcgcattgaaatatttataacagaataattaaaacacattttgcgggaaaatgcaagaggaaaacgcgaaatttacctaaaatatatgaatttttgcatcagaaaacaacggatttccaaatcaatcgcatcaaaaattcaccgtaggggcggaccagtgtgtccgccctgattaagcgatatgcagatggtttacaagcggtgcgccgagtcggcgcaccctacggtaaagccttacatcaaatataacccgcaggtgccgtccatagctatcgaattatatcacaaatttgtttcacacacaaaataatttaacatgttagatattcaccacaattcaattcttaaacatcattgatagcgtgtaaacgccgcccagcaacaacgtattgctacgcaactcgtgtgcaccgcttactttctgcctgaagacataaaaaaaggaacccttacgggttcctttttgaaatcgctcttccttaccaggatgccttgcggacacccggaatctggcccttgtaagccagctcgcggaagcagatacggcagataccgaaatcacgcaggtaagcgtgcggacggccgcaaatcttgcagcggttgtaagctcggctggagaacttcggcttagcctgctgcttgagaaccatcgacttcttagccatttaacttctcctccttacttctcaaacggagcgcccatcagagtaagcagctcctttgcttcttcatcggtatttgcagtggtgcagataacgatgttcatgccgcggatcttgtcgatctgatcgtaggaaatttccgggaagatcagctgctcgttcagacccagagcgtagttgccacggccgtcaaatgcgttgccgttgatgccgcggaagtcgcgtacacgcggcagagctacgttgaacagacgatccaggaactcccacatgcggtcacggcgcagggttaccttaacgcctaccggcatgccgtcacgcagcttgaagtttgcgatggacttcttagcgtgggtgatgatcggcttctggccggagatcagggtgatatcacggacaatagcctcgataaccttggagttaccgtttgcttccttaccgcagccgacgttgattacgatcttgtcgagcttcgggatctgcattgcgctctcgtactgaaacttcttcatcagagcaggcgcaacttccgcagtatactttgctttcatattcggaaccatttattgcaacctcctcttcttaaagcgtttcgccgcagtgcttgcacaccgtcagcttagtgccgttctcggtgaacttgtgcgctacacgagtcggcttgtcgcacttcgggcatacgcgcattaccttgcaggcacgcagcgcaccctcgcgctcgatgatgccgccggtttcaccctgacggcggggcttggtgtggcacttgatcatgttcacaccttcgattactaccatacccttcttcgggtttacggacaggaccttgccgcgcttgcccttttccttgccggaaagaacgactgcggtgtcgcccgtcttaacgtgcaaattgttcatttgttggcgacctccttacagtacttccggagcaagcgacaggatcttcatgtaatccttgtcacgcagctcacgagcgacaggcccaaagatacgggtgccgcgggggtttttgtcatcacgaatgataacgccagcgttctcgtcaaagcggatatagctgccgtcagcgcggcgcaggcccttaacggtgcggacgataactgccttaacgacatcgcccttctttacgccgccgcccggggtgcacttgcgcaccgagcaaacaactacgtcaccgatgttgccgtacttgcgtgcggagccgccgagaacacggattaccttcagttcctttgcgccgctgttgtcagctgcacgcagaaagctttcctgctgaaccatgtgctctcctccttactttgccttctcgatgatctcgaccaggcgccagcgcttgtccttggacagcggacgggtctccatcaccttaaccttatcaccgatgccacactcgttgttctcgtcgtgtgccttcagcttataggtgtgcggaataaccttcttgtacagaggatgtgctacacgatcctcaattgctacgacaatggtcttatccatcttatcggaaacgaccttgcctactcgcgttttgcgtaatgctctttcgctcataatattcgtttccctcccttatgccttctccgcgatctgcttctcgcggataacggtattgatacgagcaatgtcgtgcttgacttcattgatcttgttggtgttgtcgagctgattggtagcgagctgcagacggaggttgaagaggtccttcttcagctcaccgagctttgcagacagctcctcagccgtcagttctctgatctcagatgccttcatcatgcttcaccgccattcttctcacgggcaacgaacttggtcttgcagggcagcttgtggcttgccagacgcagtgcctcacgagcaacttcctcggaaacgcctgcgatctcaaacagtacacggcccggcttaactactgcaacccagtactcgggtgcgcccttaccggaacccattcgagcaccagccggatgcttggtaaccggcttgtcggggaaaatcttgatccatacctgaccgccacgcttggtgtaacgggtcatagcgatacgggctgcctcgatctgattcgaggtgatccagcacggctcggtagcctggataccgaactcaccgttcgatacgaagttaccgcgggtagccttgccggtcatacggccgcgatgaacgcgacgatacttaactctcttagggagcagcattaacggttgcctccttcctgacggggagcacgacgctcgccacggttgaagtcacgacggccgcgacggtcaccgcgacgatcgcggcgctcgaatgccggcttcggagcttcaatggagcgacccagacgcggaccgccgtggagaacctcacccttgtagatccataccttaacaccgatgcggccgtaggtggtcgcagcttcagcaaaaccatagtcgatgtccgcacgcagggtctgcagcggaatggtgccctcgtggtaatgctcggtgcgtgcgatttccgcgccgcccagacggccgccgcaggaaaccttgatgcccttggcgcccatgcgcattgcacggcccatggactgcttcattgcacggcggaaaccgatgcgcttctcgagctgagctgcaatgttctcagcaaccagggtagcgttggtgtccgggttcttgatctcgatgatggagcagcgaaccttcttgccgtacttcttggtcagctcttcttcgagcttcttgatgtcctcgccgccgcggccgacaaccatgccgggacgtgcgcactggatcatgatcttgatttcgtcgttcttgcgctcgatctcgatcgccggaacgcctgcgtcgtacagacgcttcttcagatccttacggatctcgtagtcttccacgaggaggtcgccgaacacattgtccttagcgaaccaacgggaatcccaattcttgataacgccgacacggagaccgttcggatttactttctggcccattgattaccctcccttattctttctcgccaagaaccagcgttacgtgcgaggttctcttgaggattctgaatgcacggccctgtgcacgcggcataacgcgcttcatgatcggaccgggaccgacgtgaacttccttaacgtaaagcttgtcggtgttcatgccgtgattgttctcggcattggcaactgcgctcttgaggagcttctccatcggctcgcatgctgccttgggggtattcatgatgatggccatagcttcgcccgcatccttgccgcggatcagatcgcagatcagcttgatctttcgcggggtcatgcgtacgttgcgtacaatagctcttgcttccatgttactttaactcctccttacttgccgttattggaggtcttgctgcccgcgtgacccttgtaggtacgggtgggagcaaactcgcccagcttgtgaccaaccatgtcctcggtaacgtataccggaacgtgcttgcggccgtcgtgtactgcgatagtatgaccgacgaactcagggaagatcgtggaagcgcgggaccaggtcttgaggaccttcttctcgcccttttcgttcatttcaacgactcttttgataagctcaggagccacaaaagggcctttcttaacacttctgcccatattaagataactcctttcttacttgccgttgcgacgacgagcgatctgcttgtcggtgcggtggttcttcttgcgggtcttgtaacccatagccggcttgccccacggggtaaccggagacggacggccgatcgggctcttgccttcgccgccgccgtgcggatgatcgcacgggttcattacagaaccacgaacggtcgggcggatacccagatgacgggtacggccagccttacccagctgtacgttagaatgatcagagttaccaacaacgccgatggtagccttgcagtccagacggacgtaacgcagctcaccggagggcagacgaaccattgccttgccgccttccttagccatcagctgagcgccgacgcctgcggaacgaaccagctgtgcgcccttgcccgggtacagctcgatgttgtggatcatggtaccaaccggaatgttctcaaccggcaggcagttgccgggcttgatgtcggcatccttggaagaaacgatcttgtcgccaatcttcaggccctcgggagcgaggatatatgccttctcgccgtcctcgtactgaacgagagcgatgttagcggaacggttcggatcatactccatggtcttaacctcggcgtaaacgtcgagcttctgacgcttgaagtcaatgatacggtacttcttcttgttgccgccgccgatgtggcgaacggtgatgcggccgtagctgttgcggccagcggtcttcttgaccttttcgagaaggctcttctcgggcttcaccttagacaaacccttgtaggaaagcacagtcatatttctgcgcgagggcgtcgtcgggttgaaagtcttgatagccatttggaatttcaactccttgatacgttattatcggggtggcttccccatacaattacttcgtttgaaaacacgttttcaaacgagagcggttccaccgcgcacagcgcggatgaaaccaaggctgcgaaaagttccgaccagcgaaacttttcttcgctcttgtataaaaaccgtgatacatgctcccggtttttatgaatctgcaagcagattctattgaaaacccgcttcgcgggaacactcaggctcgccttagcagccgaagtggtttttacatcatgttctcgaagatctcgatcttcttggagtcagcggtcagggttacgatcgccttcttgatgtcggaacgcttgccaacgtgaacgcccatgcgcttccacttgcccggcagcttgatggtgttaaccttggcaaccttaacgccgaagatctcctctacagccttcttgatctctaccttgccggcatcgatcgctacttcgaaggtgtacttgttgtcctgtgcgcccatcatggaacgctcggtgatgatcggcttcttgataatgtcgtatgcgtacttcattatgcgtatacctcctgcagcttctcaactgctgccttgtcgatgatgaacttgtcagcattgaggatgtcgtatacattgagggtagacgcgatcgtggtgcgtacgcccgggatgtttgccgcagacttaactacgttggtgcgaacttccggagtaactaccaggctcttgccggttgcctcaactgcgttcaggaaaccaacgaaggacttggtcttgatctcgcccatatccaggccatcgattacgatgatctcgcctgctgctgcctttgcagacagagcggacagcatagccagacgcttggtcttcttggtcaggctgtagttgtaggaacggggcttcgggccgagggcaataccaccatggatccactgcggagagcggatagaaccctgacgagcacggccggtgcccttctgacgccacggcttgatgccgccgccacgaacctcggcgcgggtcagcgtggactgagtgccctgacgctggttagccagataattctttactgcagcgtgtacaacggtcatgttcggctcaataccgaaaacagccgcgttcagctccatctcgccggtcttcttaccggtcatatcaaaaactgctactgtaggcatgatttgctcctccttcccttactttcttgcggaagccttctgcgggttcttgctgatgccagcctcgcccttggcaaccttgttgttcttaacggtgttcttcagcactacgatgccgcccttcgggcccggaactgcgccgcaaacggcgatcaggttaagctcagcgtcaacctttacaacgtccaggttctgaacagtaacctgctcagcgcccatgtgacccggcatcatcttgcccttcatgatcttggacggatcagagcaagcgcccatagaacccgcatggcggtgtacagggccggtaccgtgggtttccttcaggcgggatgcgttgaagcgcttgattacgccagcgtagcccttgcccttggaagtgccggtaacgtcaacataatcgccggtaacgaacatgtcagccttaacaacatcgccgagctggaacggagtgcagtcctcaaaacggaactccttcaggtacttcttcagggagtcgccagccttcttcaggtgacccttctggggcttgttcaggcgagcttccttaacatcctcaaaaccgaactgtacagcattgtagccgtccttctcttcggtcttgagctgagttacaacgcaaggacctgcttcgattacggtgcagggaataaccttgccgtcagcattgaagatctgggtcataccgaccttcttgccgatgattgctttgttcagcatttgtttttcctccttaaaggttattggttgacggcatttgaccgccaacatgacctcgccgcgcgtgtcgcggcagggcttcaaaccgccggtgggttaatccggtcagcttgttaacttaaattagagcttaacctcgaactcgacgccagccggcaggtcgagagtggtcagagcctcgatggtagcctgattcgggttgatgatgtcgatcaggcgcttgtgggtgcggcgctcgaactgctcacgagaatccttgtacttgtgaacagcacgcaggatggtaacgatctgcttctcggtcggcagcgggatcgggccggaaaccttagcgccgttgcgcttagcggtctcgatgatcttctctgcggactggtcgatcagctcgtgatcatacgccttcaggcgaatgcgaatcttctgtgcgtttgccattgtggaatttcctcctcgtatgtgtgccatacattaaataatgttttgactcgctacggagagaaactgcaactccgccgtgcgtatcacgcaacgggcatgaaaataaccgggcacactgactccgcagcgcaacaatccggtcacgataagaaacgtaagtggttcaaaccatcggcttgacggcgcacgcgccgcgagtcccgaatttacgcatgaacattgcgtttttgctgaatatctgaattcagctgatagcagttatctcaaccgcccgattgtcggacctactccaccgaagttacctgctcacagcagcaatctccggtatcatcgcgttttaacttgctctcgcaagtgcttatacataatacaatactttcacgggaaagtcaagtgtttgcacaaaattttcagcgattttttgtgtaaatcggaatttttcgcgttatgcacaaaaacagacccgaaaaccatcgttccaggtctgttttgcccaatctcaatcggtaacaaccgctaagatccacgaatctgcatggctgtcgatcgtcagatcgaccttatcataggcagtcaccgtgcagcctgcctgttctactgtctgcagagtcttttcgagcgtttccatactgttgtccaaccggaaccacgaaacaccgttctcctgcgcgagcagctcaccatcgatatccggcaggctgctgccgccgacggccacatagcagtacgcggtgtgtgcgccgtgcaggctttgcggtagcgtgagcaccggacgggtctgcacctgtgtctgtaccgactcatcagcaatcggctcaggagctgcaatcgaccgctcgctgtctgcatactgctcggcatcgatgcccgcatcgctctgcgtattcgccgcagagtcctcgccggtgtcattctgtccgctgtatgcgctgccgttcgtactctgcgaagccgtgccgctctgctgcacgctcgaattcgatgctccgccgctcgatgcatcggcgttctcccgcacggactgcttgatctcattctgcataccgccgtccgccgtgcagtctcctgcgtccgccgaggcagaatccgctgccgccgtgctgccgctgcccaccgtactgaacgcgggcatcagtccgccgccgagcacgaccagcacgacaaccgccgcagcggctaccatcgtaaacaccggcagacggcgcatcggcttttgcggcgcgaccacccgaacggtttcctcctgccgcagacgttccataatgctgtcatgcagtccggccggcggctcggtttcgtccaccgccagcatactgtgcatctgctccagatcctctttcagcgcggcgcacgatgggcactctgccagatgctcctccagcttttgcttttcggaatcggtcagggttccgtccacactgttcgagcaaagctgttcaaaatattcctcctcattcatgctcctcgcctccttccatatctttagacgaaggcaaatgaaaaaggttccctcgtttgagtaaaattttgcgtaaagcaatgcgtgcgcgtgacagccgcgactttaccgtaccttcactgacctcgagtatctcagcgatctcggtgtagctcatgccggaaacgtcccgcagcaggacgattctgcggtgctcgtcgctcacctcatcgagcgcggcggcaagctcgcgtcccagctcgctgttctccaggtgctcctcgggagatggagccgtatccggaagcggcagttcgcgttcctcgtcatcctcgccctgcacgagcggctgcgtcggcggctggctctgcttatgccgcgcgtaatcgacgcactggttcatcgtgatgcggaacagccaggtcgcaaagccgctgtccccgcggaagtccttcatcgagcgccatgcccgaaggaaaacctcctgcgtgatatctgcggcatcctccggcgagccggacgagcgcagcgcgatcgcatacacgcgcttttcgtagcgcgttaccagctcctcaaaggcagaaagctcgccgcgccgcgcctgcgccacaatatgcttgtcgtccactgcgtctcccctctctttctcttaccttatttattatatgttctccttcgccgaaacgaaggctttcagttcgtctgcgatttcatacaggtcactcagcttggtgagtgcgcaaatgcggttcttgaacgtcttgacaccgctttcccgcttgagatagcagttaacgtgtcggcgtgcctcgagcatggcgatatgctcgcccttctgctcggcggcaagctcgatctgccgcacggccgtgtcaatgcgctccgcgaacggcggcagcgccggacagatgccggtctcgagcagtgcatttgcccgctcgaacagccacggatcaccgagcgaacctcgcccgatcatcacgccgtccgcgccggtgtgcgcgagaatgcgaaccgcgtcctcgggttcggccacatctccgttggcgaacaccggaatgcaaaccgcctgcttgacttcacgaatcacatcccagtcggcggtgccgctgtactgctgcgagcgcgtgcgtccgtgcagcgtgatcgctgccgcgccggactgctcagccatttttgcaaattccacgcagttgacgcttttttcatcccagcccttgcgaaacttgaccgttaccggcacatcgaccgcgtttacgaccgctgcaatcaccttggacgcaagctccggatccttcatcagcgcggagccgtcaccgttgttcacgatcttcggcgccggacagcccatgttgatgtcgatgatatcacagccggatttctccagcgccagtttcgcgccttcggccatcgtgtccggctcgtgcccgaagatctgggcagccgccggatgctcgtccgcccccagctcgagcagacgcggcgttttcttatccttatagcacagcgcctttgcggagaccatttcggtcacggtcagcgccgcgccgtgctcccggcagatatggcggaatgcaagatcggtcacgcctgccatcggtgcaagcgccagttttccgttgattgttacgttgccgatctgcatatcgttcctccgtcttatacatattatataacggtgtatattttaccataacgcgactgcaaatgcaacttacagaatggatgcacccatttttcgaccgaaaaacgcaaaaacagggcaaatccgaggatttaccctgtcgatatatttggttacattaccatgctgagaatcttctcgctgaagaaatacccgaacgaaatgagcgcggtattccacaccgtgatgcccaccgcagaccagccgacgaaccacttgaccggcatccggagcagtccggccgggatggaaacaatggtgcggatacacgggatcacgcggatgatcgccagtccgcgcccatgctgtgcgtcgataaattcatggcatttacgcacgagagacttgaatttcttgctcctgccgaacagtttctccatcaccggttcgccgccccagtagcacacggcgtagatgaccagactgccgagcacaccggcgaccacgctcagaaaaaccgtcagcggcagcgacagctcgctccgggcaatcagcacaccgacgcacggcatgataacgcctgccggaaatccgggcaggttcatatattcgcagaaaaccacggcacagaccaggatcagtccgtactggttgaacagctgaaaaaaggtttcggccgtcataatagccgcctccgtttgatctatagtaagcgaaaaccgaaattttcgtctgtgtactatagtataccaaccaaaaccggatggtacaagggaacggccactcattttataatctgtttacaaaacgagcgccgtcagcgcccaaatggtgccgatgagcagtgcgccagcccaaaatccggcaagcaaagaaagaccgtccgcctttcttctcgaccgccgtctgcgcggcagatagctgtttgcgatgcggcaggcctcccgcaccatgtcgccgcgcggtgcattgtagtcccgcacaaggaaaatagcctgctcgaacagcgccggctgctccggcttgacgacaatgacgcggcggctgacacctcgtaccatatagattcctccttttccctttgttccatcattcccctctttcgtgattttataccagtctcattccagcttttcaattttcatgaccattacggtcctatcatcatcgtgtccgcggcctttcgcctcgttcacaagctgtgccgcgatctccttcgggctgtcgcctgcatgcgcgatgagcagctgccgcacccatttatcgtccgtgccgtcggtcacgccgtccgagagcagaaccacgatatcgccgtcgttcatctgcagcggcacggcatcgcccagctcgtcctcctccgccagaccgatgggcagcgccgtgcccggcagaatggtccatcgaccgttcagccgcatgtaggtcggtgcggcgccgcacttgaggttttccgcgcgtccgctgaacaggtcgagcgtgaatgcgtccagtgtggtgaagcgcatgccgtctgaccgcaggcgcagcgccggagagaccgcgtgcagcgcgtctccgaccgaaatgcctgcacgcaggaaccgctcgagcgaggtgatgagcatgcggctgtcccgcgacgcggcggcacccgagcccatgccgtccgacaggagcaggcacgccgttccggtgtcggtaagaaagtagcacgcgttgtcgcccgagaccgacgcgccctccttctgctgacggccaatgccgaccaccgcacggtacggcgcccgctcgtgcatctcaacatggatgccctggctgccctttttcttctccggtgcggtcagcgtcacgcccagcagcgccgacagaccggctgaaaagccgtccccttgcttcatgatgtcgtcgatgccctcgccgtacagttcaacagtcagcctgccctgcgaatcccgcaccgcgcacacgcggtcgatccatccgaacgctgctgcgtaccggcgcacctgccgttccatcagcggctgcgccgtttcatcctgcgtgacctccgcgccaagctgccgaagaatatccgtaatgcctgcgtattgcctggcaagcaggctctggttttcctcctgctgccgccgaaggctttcacgctcgcgcagcgcaaacagcgcactgttgatggcacgcatcagctcgggcagacgcgcacaccgtgccgcaaaatgatagggaaaatcgctcatttccgctcgcccgcgctgcagcatcggctgggtcacatcattgagcgccgccagcgtgctcacatagtcccgctgccagcactgcgtacacagcatgcagtttttgcagacatgatcgctcgcgtagtcgaataccgcccgaatattccggtctccggcggctttgccctcgctgacgccgtgcagcatagcaaggtacagctcgtagaacgcctgcgccgcctcggtcgcacaggtgcccgcgagtctgcgcacacgctgactggcggcttcgcccatcagggtatccggcagcaggctgcgccggatggcctcccacacgaagggcggcagcgccgcgaacatgaggaccgcgcagaacagctctgcaatcagcggaatgaacagcggatgctccacgccgagcatagccgcgcacaatccgccgccgagcgcacagaccgaaaaccagccgcggccgctgtcatgaaacagtccggcaacgagcgcacacaggccatagcagcaggtgaacaaggctccgtagccgatgttgagatccattgccgcgccgaacgcgacaccggctgccgcgcccgccgccggtccgccgagatacgccgccgccagcacgagcagcagcgcacccgctctcgcgggagcgaacacgccaaacagattgatacccgaaagcgataaaagcacggttgcggtcagcaccaaaagcgttaccggtctgcgccagtcgttttcgtcgcgcggcggtgcaaaggccgcgccgtacatccagcacacaccaaacgtgatgccctgcacgagcaggaatgtcagcaccgccggtgcggtcagctctgcgccgagcggcagaaacacgaatgtacacgccgcgcttgcaaacgttgctacacccggtgcaaaccaccgctcggacatcacgcgcagaccggcgcacacgctcatcacgcacagcaccagcagcgctgccgcggcgtaaatgccgccgtggaatccgtcgccgcgcagcatgacaccgcacaccagaccgccgagcgcggacagacccgctcctcgagccatcaaggccgccgtcatcgccagcccgaacggcatgtacccaccaaggatggttccctgtgccagcaccgcacacagcacgaatcgctgtacgcctgtgatgagcgtccgcaaatgctcctgtttccataatccggcagcccatgctgccgcatgcccgatccgcaccggtatcgacgcggaccgtcttgccctttgtttatccatttcgttacgcctcccttgctgttttcccagtatatcccaatgcagacgtgccgcttgacgggaaataacagcgggaattgcgttttgaaaaaagttaagcgcatattccaactttcgagcgcgtaaaagtggcggtttcgccacagaaacaaaaggatagacagcggcgcttataaagtgttggaatgtgcgctgtcattagtgcggcgggccaaaaggatagacagcggcgcttataaagctcgagaatgtgcgctgccgtcagcgcgtggtccaaaaggatagacaccaaggtttgcccgtaggccactaaaccttgttcccgcgccgtgcgcggattaaatgagtactatcctcttgggactccatcttcctttattagatagtctggcgcagaccagagaccagcgaccgctccgaaaaggagaacggcagaggattttttcttccgtagaggcgcacagtgtgcgcccatgtcttaacctatccgcagtgtcgaataatttactgctacacatatcggctgctctacgcaggcgcggcacaaggtgaattgcccaaagggcaagagagggtcctctggaggatgaccgtgccgcgcaactcttttacgcgttattacagacagttcctccgaatttcatttatcaaccaaccttaccgtagggtgcgacgacctcggcgcaccgcttgtcacccatccgcaccttgcatacccgtaggggcggccattggccgcccacacaacggaaaaccaccatgtcaattctccattctccattttcaattctcaattcggcgcaaaaaagaacccgaaactctcgtttcgggttcttttatcttactccagctcaaacgctccggtatagagctgataatatttgccgtgttccgcgatcagctgctcatggttgccgcgctcgataatatgaccgagttgcagcaccataataacgtctgcgttttgaatcgtggacaggcggtgtgcgataacgaacaccgtacgtccgtacatgagaccgtccatgccggcctgcacgatggactccgtgcgggtatcaatcgagctggtcgcctcatcgaggatcataaccggcggatcgccaaccgccgcacgcgcgatggaaagcagctggcactgaccctgcgacagactgccgccgtcgccgtcgatgacagtatcgtagccgtccggcagtcggcggatgaagtcgtccgcattggcaagctgcgccgctgcctcgacttcctcgtcggtcgcatccagacgaccgtaacggatattatcgcggatggtgccggtaaacaggttggtatcctgcagaacgatgccgagcgagcggcgaagatcggcttttttgatcttattgatattgatgccgtcgtagcggatcttgccgtccgcgaggtcgtagaaacggttgatcaggttggtgatggtcgttttgcccgcgccggttgcaccgacgaacgcgaccttctgaccgggctcggcgtacagcgtgatgtcgtgcagaacgatcttatccgggttataaccgaaatccacatcgaagaagcggacatcgccgcggacctgcgtgtaggtggtggtgccgtcttcgtgcgggtgcttccacgcccagatgttggtcttttccggggtttcaacgagttcgccgttcttatcgtacttggcgttaacgagagtaacatagccgttgtctacctcaggctcctcgtccatcagctcaaagatacgctcggcaccggcaagcgccataacgatggagttgaactgctgcgaaatctgcgttaccggctgggtgaacgacttggtcagctgcaggaaggacgcgataacgccgatggtgatgctgtttccgaccacgccggacagcgccagcgcaccgccgacaaccgccaccagaacgtacagcaggttgccgatgttcatcatgatcggcatgaggatgtttgcgaaggtattcgcgcttgcagcattctcgcgcagctcatcgttgagctcatcgaactgctccttgcacttttcctcgtggcagaacaccttgatgaccttctgaccgttgatcatctcctcgatatagccgttgaccctgccgagcgacttctgctgctcgaggaagtacttcgcggactgaccgcccagcttctttaccaccttgagcatgacgcacacgccgagcagtacgaacagcgtcagccatacattcgtcaccagcatgccgatgaacaccgagataatggtcatcgccgaggaaaacatctgcggcacggactggctgagcatctgctgcagcgtatcggtatcgttggtaaaatggctcatcagatcgccgtgggtatgcgtatcgaagtagcgaatcggcagcttctgcatgtgcgcgaacatctcgtcacgcacctttttgagcacgccctgcgaaatgccgaccatcagccagttgtagatgaacgtagtcgcaatgccgatgagatagatcaccgccatactcatcagtgcatgcagcagaccggtaaacaccggagatgcctgcagcagcagcggagaaatatagtcgtcgatcaggcttttgaggaacatggagcctgccacgtttgccacagccgacagcagaatgcagatcagtacgaccacaaactgtacgccgtagcccttctgaatatatttcataagacgtccaagcgtctttttcggatttttgctgcgcttgccgcccatcatgcctctgcggccgccgggtccgcgcatctgaggtcttgccattattcctcaccgccctttctgttctgctggttgtagatttcctgatagatcgtgttggcggcgagcagctcatcatgcgtgccgacagcctgcacggtgccgccgtcgagaatgacgatctgatccgcatcctgcacagaggaaacacgctgtgcaatgataatcttggtcgtgtccgggatttcctccgcgaatgccttgcggataagcgcatccgtcttggtatctaccgcactggtcgagtcatcaagaatgaggatcttcggctttttcagcagcgcacgcgcaatgcagagtcgctgcttctgaccgccggaaacattcgagccgccctgctcaatgtgggtgtcgtacttatccggcatctgctggatgaattcatccgcctgtgccagacggcatacgcgctcgagctcctcgtccgaggcattttcgtcaccccagcgaaggttttccttgatcgtgccggagaacagcacgttcttctgaagcaccatggcaacctgatcgcgcagcgcctcgatatcgtaatcgcggacatccacaccgccgaccttgaccgtgccgtgcgtggtatcgtacaggcgcggaatcagctgcacgagcgtagacttcgcggaaccggtgccgccgagaatgccgacggtctgaccggccttgatatgcaggttgacgtttttaagcgccagcttgcgctcatcgcccttgtagctgaaggaaacgtcatcgaactcgatcgcgccgtccttgacctcgtgaatcgggttcgcggggttgtgcaggtcgggctgctcatcgaggatttcggcaacacgctctgcgctcgccttggccatggtgatcataacgaaaaccatcgctaccatcatcaggctcatcaggatctgcatcgcgtaggagaacatgctggtcagctcgccggtggtcatcgagccgacgacgatcagacgcgcgccgaaccacgaaatgagcagcatgcacgcgtacatgcagaactgcatcagcggcataacgcctgccatggtcttctgcgccttggagaacgtgcggtacagcatgccagaaacgccctcgaacttttcagtctcgtggtcctcacgcacataggtcttaacaacgcggatgccgcgcacattttcctgtacgaccgtgttcatgcggtcgtagatcttgaatgcgcgctcaaagaccggatcgacaaccttcatcagaatgcccatgccgattgccagaatcggcagcaccgcgaggaatacgagcgccatcctgctgttgatcttcatcgccatgaacagcgcaaagaccagcatgaccgggcagcgcaccgcgatgcgcgtgcacatctgaaaggcgttctgtacgttggtaacatcggtggtcagacgggtgacgatcgaaccggtggagaacttatcaatgttggaaaacgagaaattctgcacattgtagtacatatcgtgacgcagattgcgggcaaagccggttgaggctctcgccgcaaaggtgccggctgccgcgccgaacaccagcgcgagcatggcgcacagcacaaggatgatgccgtatttccaaatggcggccatatcctgcccgtcaatgcccttgtcgatcagcagcgccataaccatcggaatgatgacctccatcacgacctcgagcacaacgaaaaacggcgtgagcagtgcgtcctttttgaactcacgcacacttttcagcagtcgttttatcattatttctgtccctccctgcacatattgcattggtactgctccagattggagcggattttttcacagaccgcaaaccagcccttcagctcgtcctcggtgatgccctgccgcagaagctgttccatctgctgcatgcgttcagtaatgtattcatccattgcacgcgcctgctcggtcagcaccagacgtttcaggcggccgtcatgctccaccggctcacggcggataatgccgtgctgctccatcagctgcagtatgcccgttgcggtcgagcggcgcatctggaacgcgttttccagatccttctggaatatatcgccctgcttttcgtgtatgatcaggtgatggacgatcatcgcctgcatgccggtcacatttgctgcattcgcagtcttttcggtcatacacgccatctgccgccgaagcagattatgcagcatgccgatttctgcaccgatgcggtcgtccgagtgaccgcagcattcattatggtcacagcaattcattgttagcctccttactgttagcttgctaacatattatacaccgtcactcggcaatgtcaacgggtttcacgaaatgttcacatttcggggagtggtcgcttgcaaagcgaacggaacttgcctgcccggcgggcgcgccgtacccacggcgaggggcaagagggtagacaccaatggtttctaccctcttaactcccacttccttttgtttcttaacctgacgcataccagagaccggcgaccgctgcgaaaaagggaacggcagtcgggttactcttgcgtttatttcgtgaaatattcgcagttctcggataacgtactgctacacatgcgggctactctccgcaggcgcaacacaaggtgaattgcccaaagggcaagagagagtcccctgggggatacctgtgtcgcgcaatttgttggtctggtggctacagacggcacctgcgagtttaatttgataatgaatgtttaccgtagggtgcggcaaggtgaattgcccgaagggcaagagaaggtgccctggggtacgacctcggcgcaccgtgctatccggctggcactcaataaaaatgaaaaaatggagaatgccctacctcggggttcattctccattccgacttgctaagagccgccctatgggcggttgctcgctggacgcccactgcggtgggtgtctccattttcaattttctattatttcgcctgatatgccggtttgagaaacatttctccaagatactgcttgccggtttcggttcggaacacgcggtctttcgcggttttacactgctctgccgtcataccgtcctcgtaggcgttgacaaggaaatccgcttcaagcagaatacggaaatctttttcctctccggcggtataggtatggtgatgcgcgatgagccactgcacgcgctcgctctcccgctcatctgcgccgcactgctgcagcatgggagccgcgaccgccgggccttccatctcctgccagtgtccgccgctcgagccgtgcttccgttcggcttcgtggatgccgatatcgtgcagaacggctgcagcttcgagtatattctgcttctgctcatccagaccttccctgcgcccgagcaggcggctgtacgcgtatacctttataaagtgctgaatccgttttgcgtcgcctgcgtcatacgcgatggcgagcgcggtcagcttttcgatgtcgatcatgcgtgtcactcctttggcgcaagcatagcaccgcacgaccggatttgtcaagtcagggtaataccacataattgaacaagagcgatttacgagtaaattttgcggtctgactaggcgtgattttgcggtaatactttgtgtattaccgtgaaagcacaacgacgtcagagcacaaaatttccgtaaagcgccgcagtgtaattgtgcggtgttaccctaatcctgtccagccgtatttcgccatatccacgcggccgtcctcggtgaactcgatgccgtccgcttcgagcagtgcgcgctggatatccgcgccgccgaacgcaaacgccggtgacgttcgtccgtctttcgttaccacgcggtagcacggaatcccctccggatcgggattgacatgcagcgcatagccgacgacacgcgcccatctcggattgcccgcgagcagcgcgacctgcccgtagctggccaccgttccgcgcggaattttcttcaccactgcatatattcggtcaaagctgtttgccatagctaatccacctttcttttaccagtcaataccacataattaagcaagagtgctttgcgagtaaattttctttttttaacgagacatggttttgcagcaatactttcggattgcaagaaaacacaccgaagtcaagaaagtaaattttcgcaaagcaccgccgctttaattatgcggtactggctttattatatcaagtcagattgccaatatccataggtttttcggcctaaaaaactgtataattttatcgtgctaaagtattgcatatgcaaaaaaattgctatataatagaaccgtcaccaaatataaaagcattccactcggattacttacgaaagttaagcgagtggtatagaatgtaaggaggacaataaaaatggcacttaccaattcttatctgcagggcgtgtacgaaaccgtacagaagcgcaacccgaatgagccggagttccagcaggcagtttacgaggttctcgagagccttcagccggttgttgaagctcgtccggagctcgagaagaacggcatcatggagcgcatcgtagagccggagcgcatgttcatgttccgtgtaccgtgggttgacgatcagggcaaggttcaggttaaccgcggcttccgcgtacagttcaactccgcaatcggcccctacaagggcggtctgcgtctgcacccctctgttaacgcatccgttatcaagttcctcggctttgagcagtgcttcaagaacagcctgaccactctgccgatgggcggcggcaagggcggctccgactttgacccgaagggcaagtccgatgctgaaatcatgcgtttctgccagtccttcatgaccgagctgtgcaagcacatcggtcagttcaccgacgtaccggccggcgatatcggtgttggcggccgtgagatcggctttatgttcggccagtacaagcgtctgcgcaacgagtacaccggcgttctgaccggcaagggcctgtcctacggcggctctctggcccgcaccgaggctaccggctacggcctgtgctactacatgaaggaaatgctcgcatacaagggcacttcgttcgagggcaagactgttgcaatctccggttccggcaacgttgcaatctacgcttgccagaaggctacccagctgggcgctaaggttgttaccatgtccgactccaacggcttcatctacgatccgaacggcatcaacctggatgttgtcaaggacatcaaggaagtaaagcgcggccgcatcaaggagtacgctgagcgcgtaccgggcagcgtttacaccgagggtcagcgtccgtggggcaccaagtgcgacatcgctctgccgtgcgcaacccagaacgagctgaacgaggagaacgcaaaggctctgatcgccaacggctgcaagtttgtagctgagggcgctaacatgccgtccaccccggaggctgttgcagcattccaggcagccggcgtattcttcggcccggcaaaggctgctaacgcaggcggcgtagctacctccggtctggaaatgagccagaactccctgcgtctgtcctggaccttcgaggaagttgaccagcgtctgcacgacatcatggttaacatcttccacacctgcatcactgcagctgagaagtacggccacaaggacaaccttgttatgggcgctaacatcggcggcttcgagaagatcgctgacgctatgctggctcagggcgtatgctaattttcgattgaaaggacgcatccctttcaatcgagggacgcccttgacaggcgctgcctgtaagggctaccgcaataaaagagcaccggaatttcgattccggtgctcttttattgtttgctaaaaatgacccggcaaagctgggccatttttgtcgcgctgaaagcgctccatttgatgcgctccgcggcgtgataggttatctatgtgctgaaatccccgtcggggattttatgggttggcgtgaacgctgtcgcccacgaaggactcaccgccgacaggcggctgtcctgtgggtgcggtttgcgggtcatactgcgtattttatgccgcgaactgcgttcgcgggtgcgggccccggcggcacagccgcctgtgtcccttattgcacatccggctgctctatgcaaaaaagaccgccgtaaggcggtcttttagcttatgcgttttcggaaaagtctgcgagacgcaggttctcgttatggtcggttgcgtaggtgatattccacggcgaggtgaacagcagcaggctgttgcccttgagatcctcgacgatcttggtatcgctcgtgagctggagtttcttgatgtcgaagtcctcctcgtcattctcaacccagcgaacgtgctcatacggcaggttttcgcggatgatctcaacgttatactcgttcttcaaacggtactcgagcacctcaaactgcagcacaccgacaacgccgacgataaccgattccataccggcattcggctcgcggaagatctggatggcgccctcctgtgcgatctgctcgacacccttgacgaactgcttgcgcttgagcgtatccttctggcggacaacggcaaacagctcgggtgcgaacgtcgggatgccggagaacacgcacttatgcttgggatcgcacacggtatcgccgatggagaacacgcccgggtcaaagataccgataatatcgcccgcataggcttcgtctacgaccgaacgatcctgtgccatcagctgctgcggtgcggcgagcgccatcttcttgccggactgaacgtgcagaacgtcctgaccgcgctcgaacttgcccgagcagatacgcatgaatgcaacacgatcgcggtgcgccttgttcatattcgcctgaatcttgaacacaaacgcggagaaatgcgggtcgaacgggtcgatcacaccgatatctgcagtacgcgcggtcggcggcggcgtcatctgcaggaacttcttcaggaacggctcaacgccgaagttggtcagcgcggaaccgaagaacaccggcgacagcttgccctcgtggacagccttgaggtcgaactcatcgcccgcaccggagagcagctccacatcgtcgatcagcgtctggtactggtcctctggcagcagtccctcgaggatcggatcgtcgatcgacaggcgttgcgccttgacctcgtggcggaaatccgcgccctcaaaggcaatgacctcatcgtccatgcggtcgtacacacccttgaagcgcttgcccgagccgatcggccagtttaccgcataggtgccgatgcccagctcgttctcgatgtcctcgagcagctcgtacgggtcgcgtgcctcacggtccatcttgttgataaaggtgaagatcggcacgccgcgcatcgcgcagaccttgaacagcttgcgggtctgtgcctcgacgcccttggaggcgtcaatgaccatcaccgcagagtcagccgccatcagcgtgcggtaggtatcctccgagaagtcctgatggcccggggtatccagaatgttgatgcacttgccctcatagcggaactgcagcaccgaggacgttaccgaaataccgcgctgcttctcgatctccatccagtcggaaaccgcatgacggctgtttttcttgcccttgaccatgccggcctcctgaatggctccgccgtagagcaaaaacttctccgtaatggtggttttaccggcgtcagggtgcgaaatgattgcaaatgtgcgccgattttcaatttcttttttcaggtctgccacagactttttcctcccgatctatcaaaaatctaatattgttgtagaatgtacacagaatgttcacaattcaccagtattataaatgacgtggaaagcgtaagatccccccacatgttcttgctttctactctctatcctaccttttattgcgggagcagccggacgaaagttcggctgttcctgtttttttacctttttcaaaggtaaaatgagagtttacgttgtaaattctattcagcaccatctatccggtgcacacgatccgcgaagcggtacgctgtcaccgggcgtgctctgcacgctgacgctcttcttccagttaactccaacggtgccatgcacagcaacccagtaaaatcgttgcgcaacactgttatgttgcgcctgcgtagatgaacccgtatgtgtagcagcaaggaatctgacactgcgtacaggcagagacatgggcgcacactgtgcgcccctacggtagaaaaaatcctctgccgttccccttttcgaagcagccgccggtctctgatttgcgtcaggctatcttaggaaaggggtgattcacagaaagggtggaaaccttggtgtctaccctcttgtgcgcctgccgcgaaggcaagaaccgccgcatactgcggcaccaatttccatcaaacgcaaaccttacaaggatgcaaaggagccattacagctcctttcgaccctccagcgcgcgggtcagcgtcacctcatcaacaaactccagatgcccgccaaccggaataccatacgccagccgcgtaatcttgatgccgaacggctgcagcagccgcgaaatgtacatcgccgtggcttcgccctcggtgtccggattggtggcgaggataacctcctcggtctcctcctccgccacgcgcttgaccagctcgcggatacggatgtcgtccggtccgacgtgccccatcggagacagcgtgccgtgcagcacatgatacagacccttgtactccttcgtgcgctcaaacgcaattacgtcgcgcggctctgccaccacgcagatcaccttctggttgcgtgtcttgtccgaacagatcggacagatctcgctgtccgtcagattctgacagcgcctgcaggtgaacgtcttggcttttgcttcacggatggcatccgcaaaccgctcggcgtcctctttcggcaggtcgagcacatgaaacgccagccgctgtgcggtcttctggccgatgcccgggagctttgcaaactcctcgatcagccgttcgaccggcggtgcaaaaagctccattacagcagaccgcccagaccgccgccgatgccgcccgtaatcgcggacatctggctctgcgacttatcagaagccgccttgagggcctcattgaccgctgcaacgaccagatcctgcagcatatcgatgtcgtccggatcaacaacgtccggcttgattgcaatgctcttgagcgtagaagtgccggttacagtcgcggtaaccatgccgccgcctgccgtgccggtggattccatctgcgcaatctcctcctgcgccttgagcatgctctcctgcatcttctgtgcctgcttcatcatcgcctgcatattcatgccgccgccgaagccgccgaaacccttaccctttgccataataaatgtcctccttaaagctgtttcacttgaatatccattgatttagcgcggtcgatcagttcatcgactgcgatattttttttcacaacaagctcctcgcccgcttcgcgcaccttgaccttgataggtgcaccgttcagcttggccgcctgctcccggatgaccgaaatggtcggctcctttgccgcgagaatggccgtcattttgtcctcgcagagaatgacgagcgcgttgtcctcaagcacgcctttcgcgctcagcttgatattggtgtgtgcgccgatgttgatcttgccggtcagcgcttcgagcaacggctgccactggctccacagcgtcacttcctgcttaggcgtgtctgctgcggtcccgtcttcctctcgcgcccagtcaggcgcatcctcgtcgcccggaagcggcggtgcatcatcgtcactcggcggaggcggcacatcgcctgcctgctgcacggctgctgcgggcaccatctgcaccggaacgccgttcttcagcttttcctcgagcgcttctacacgcccgccgagcgtgtcatagctgtcagcgcccagactgcacagccgcaccgcgcacagctccgcctccacgcggcgattggctgccgtgcgcatatggtcgagcgaatcgctgataatgcggctccacgcgatgagcgtggacgaggccagaccgtcacacagcgcctgcagcgtctttacgctgtacgccggagaaataagcgcggaaacgtcggtcttgctggtcttgaccagcagtgcatcgcggatcaggccaagcatctggtcgtacaccgaggccagatcgcggcccgcattgtaatattcgtccagcaggccgactgccgccgcgagatcacccgttttcaggtgctcggccaggcgaatgccatcgtcctgacccatcacgccgagcgccgccgtgaccgttttctcgtccaccgcaccggctgccgccgcacggtcgagcatggaaagcgcatctcgcatggcgccgtctgccagccgggcaatcaggcgtgccgcaccttcggtcagcgcaatgccctcacctgccgcaacatccagcagccggcgggaaatatcctccgcgccgatgcggcggaaatcaaaccgctgacagcgcgacagaatggtcgcaggtaccttgtgcagctcggtggtagcgaggatgaacagaacgtgctccggcggctcctcgagtgttttgagcagcgcattgaacgcaccgatggacagcatgtgtacctcgtcgatgatgaacacgcgcttgcggacctgtgcaggcgtgtagcgcgtctcatcgcgcaggtcacggatgttatccacaccgttgttggacgccgcgtcaatctcggtcacgtccagcaccgagccgtccagaatgccgcggcacgccgcacactcgttgcacggatcgccgttcaccggatgctcgcagttgactgcgcgcgcgaggatcttcgcacaggtggtcttgccggtgccgcgcgtgcctgtaaacagatatgcatggctcaaacgtccggactgcagctgcgcgcgcagcgtgtccgtaatatgctgctgcccaatcacatccgcaaacgtctgcggccgccatttgcggtataaagcctgatacaaacgaaaatcctcccctcaataaaataaagaggcgggcgtaagcccgcctcaaagcgtcttccgcgaacaaagttcgcgcattaaatcaaccaaccgctgcatgcagcgactaaccacatggcaggttttcgtccagaaaaccgagtcatcggtctccgccgcttcacggcggcattcaatcgaatcttacggccccgccgtaagattcataaaaacccgcgacatgtgcgtgggtttttatacaagacggagcaaaagtttcgaccatcgggaggaacttttgtcccgccgggatttgtccgagccgcaggctcggcacatccccttcgatcgaaagcgtggtttcgatcgagattcgttcagcgccccacaagaccgcacacaggtaattcgaatacacacacccggctgcctttccgcatttcgggctcagaatcggcagatctgcggcacacgatggtttctgcttaatgctgctcggttccccgcctgacatggttcacagtcctccgttgcgcagtaccggttcctcatcgccctgtgagtggctgcctcgccgcatgtgtgctccttgttacccgcatagtccccgctgaagcggattgcgggttcaaggcaccgctaacgccccgacttgtgcggccttgtgcggcgctgaacgattttcagttttcagtttgtgccgaacaattcggctttatgcttccggatcctccgagctgtcgccactgtctccgctgtcgccaccggaatcgccgctgtcgcccgaatcgtctccgctgtcaccgccatctccgctgtcgtcaccggaatcaccgctgtcgacgctgtcatacgatccgccgtcaccggaatcctcattgccggtgtcggtatccgaagagctgctgtccgaatcgctgtcatcttcttcatcgtcgtagtaataattatctacgcccatgctcccgaaatcatacttgttttcgatattctgatgactgcaggtctcggtcggaaccttgtccttccagaatcggccggttgcagcacgtcccgcagcgcggcacgcaccggatgccagcagaccggtatccatacagtaggtgacttcctcgaaatcctgcggatgcgaatcgaataccagaccggaatcacccgcatgcaccttctgcataacggccagccagatttccgccgcattgcggccgtacaaaccatccagacggtagttatgctcgtagcctacccataccgcaccggaatacttcggcgtgatgccgcagaaccagatatcggtattggaggtggtggtaccggtcttgccgccggtttctacaccgtcaagctgaatgccgtaggcggtaccgtgtgcggtaacgttctgcagacaatcgagcatataataatccgtgcggacattagtaaagcccttatccgtgttaggggtattctccattatggtgttgccttcgctgtccgtcaccttggtgtaggtgcgggtaccgccgtaaacaccgtcattgatgaaggtcgagaaaccgcccgccatctcacgaacggtaacgccgtccgtcagtgcgccgagcgccagcggtgcaaggtcgatatccgactgcacggtaccgtcctcattggtgcggctgtctaccagcttaaagccaagctgctgcgtcatgaattcgtaggacttctgcggagtcagctgtttgagcagctgtgccgaaatggtattgagcgaacgcgtcataccttccttgaccgtcattgcacggccggtcggatatttgccgtcgttcatcggccacggattaccttcctcatcctgtatgagcgcacggtcgtaaaccgtggtgtccggcgtagcaataccggcatccatcgcaggaccataggtcgccagcggcttgatcgaggaacccggctgacggcgtgcgtcagacgcgtaagagaagccgcggctgctggtcttttcaccgcggccgccggcaataccaacgatatcgccctgcttgtccgtgatgaccatggcgctctgcggaatttcgccgtacttttcggtgttcggaaaattatctgcgttagcccagacctcatcgagtgcattctgcaccttggtatcgatggtcgcatagatgttcagaccgccggagtaaaccatgttctccgcaaccagacgggaatatcccttttcggtcatcaggtcgttgatcacgtccttgatgacttcatcagtgaagtagctgtaggtggacttgatctcctgctgatactcctcgtaggggcggtagttaagctcctctgctacggcagcctcgtactcctcctgcgagatcatcttctgatcgagcatctgtgcaaggatggtctcctgacgctcctttaccttttcgggatggttataaacgtcgtaaatcgacgggttgttggtgagacctgccagcacggcggattctgccagatccagctgcgatacatccttgtcaaagtactgcatcgccgcagtctgcacgccgtagctgttgtagcccagatagatcgtgttcaggtacatgaccagaatacggtccttgtcgtcaatctctttttcgagtgcaaacgcgcggaaaatctcgtttaccttgcgctttaccgagtaatcgttgtcagccgtgatgtttttgatcagctgctgcgttatcgtggagccgccgtactgcgtgccgccgagcagccaacccttgaccgcaccgatcgtgcgcacccagtctacaccgtggtgcttgtaaaagcgctcgtcctcgattgcaacgactgcgttcttgagggtatccggaatcttgtcgctgtccacccattcacggttttccttgcccttgatggtttcgtacagcgtgtattcatcggaatccgattccttagcatagatgaatgaattcagattcagacccagtcccttgctgatctccaccgcagtttcctgcgcggacggattgatatagatgtgcacatacatcgcaaacgcaatgccgcagaagcagccgcacagcacgccgatcaataccagtgtaatcagtatgcgggagagcagatgtccgatccccgttcctttttgattgccagttgccaatttgttttcctccttgccccacgatatgcaccgcagggtcctgtcgggtaagacgcggaacacgtcctatttgttcccgcacacggtcttgtttttttgaagcaccgtgtattgttggcaataccgtaaaattcatcggtattaccgtcttataaggctaaatgaattgtacaatagctgcctgtgccgattttcttccggcagcttactgccgatgtaataggcactctgatagcattataccacaggactttgcaaattccaaacattttttacactgcttttagaatagaccgtatttttgtgggaatactcaaagcaagtcccactgagtgaaggagttttgactatgatgcagggtttttatctgcttgccatgcagcaggcgcggcggcgcacgctgcttgccgcgctggcgtgtcttgcggcaatgatcagtctggtgctggccggacgcgcgctgctgtccgcgcctgccgttccggcgagcgcagcaattagttacacggtgcagagcgaaaatgaccggcttgtcatccggcagagcgatggctcggtcctgcgcacaggcatcgacacacgcacgctgccatccgccgagcagcaggcacttgcggacggcattacgctcgataacgcagaggagctggcgcggctgctggaaaattacagctcataaaacaccgtctcctttttcctcaccatacagtgtatgccacaggcggaaaaagttttcatgtgagttttgcgcggataaggctttactttttctgctttttgtattatgctgtaagtaacgataaacaccgacaggtaggatcggaaaggagaaccaaatatgcttgacggaacgagaaaattcagtctggtagacgagtccaacaaggagatgaagcgcacgcttaccactgtgtatgatgcgctcaaggagaaaggctacaacccgatcaaccagatcgtcggctatcttctctctgaggacccgacttacataaccaaccacaacaatgcccgcagcctgatctgcaagatcgaccgcgacgaactcatgcaggagctggttcagttctatctggataactgagtttttgcagaataaccgtataccttatttgcgaaaaaataaccgttacctttggcgtgaagtgaccccaaaaagttagacaatattttgaagtaaaaattgttcaagcagccgaaagggcttgctgtctgtgaattgcaggcggcaagccctttagctttgccttgattctgcggttgttgtagtaatctagatattcgatcagttccagtttgaagtattccatggagcggaactcctgcaaatacagtagttcacttttgagcagcccaaagaaattttctatcacagcattgtccagacagtttcccttgcggctcatgctctggcgaacacctttctcccggagcatctgttggtattgtttgtgttggtactgccagccttggtcagaatggagaatgaggtttgttccgtccggaatttttgcaaatgcctcgttcagcatggtcgtcaccatgctgagcacaggacgatccgatatggtatagctgaccagatcgttgctgtgcaaatcgagaatcggggatagatagagcttttctccgaacaggctaaactccgtcacatccgtgacccatttctgattcggcttttcggcatgaaaatcccgatttagcaaatttggtgcaattttgcctacttctcccttgtaggaacgatattttttcatcctgacacgacaaactaagcccagcttcttcatgagccgctggacagtcttgtggttcacagagaatttacgcttgcgaagttctgccgtgatccggcgatagccgtaccggcccctgttttcgtggtaaattgctgcgatttcttctttaacagatgcatatttgtcttctcgctgcatctgcttcaaatgatagtagaaagttgcacggggcagttgagcgattgagagcagtatactgagtgcgtgtttttgccttagcttttgaactaccagcgttttttgtgctggcgtcgctcgtcttccaaaactaaggcttgcaaattttttaggtagtctacctccgcacgcagccgctgaacctctgccagcagatcttcttctacctgcttcggcaactgctttggcggacgacccttactgctgcggccgcgccgttcaacggcaaagccttccggtccttcctccaggtagattcgctcccatgatttgatctgatctctgctgtttacatcaaatcgtcggcaggtttcgctgtaactcaatttctcttcctgcatggtttcgatcaccagcttcttgaattccgctgtgtatcgtttgttcggtactccctttggcatagcaaaacaccccacttgttagatagtataccatactgtctaacaaatggggtgcagttcagcgagggcggttattttttattctgcaaaacatttccgtgctctgcggcttgacttttaccgcagatttgctatacttatagatagaaaagggcaatccggcagaagacggttgacctgaagtaagattattctttggaaaaataaccgttaccttggccgaggacggttatttttttatggttttgacaaactcaagcagaataagtaacataatgatctgccaaatctgatccataataccacctcccttcagggagtatggtcaaccgtcttcaacatcttttgccggattacccgtatttttattgtaacctataattttcaccttgtaaagccaaagaggtatatatgaacggttttctccctatttccaaacaagatatgaccgatcgcggatggtattactgcgattttctcatcgtcaccggcgatgcgtacgtcgatcatccgtcgttcggcacggcgatcatttcacgcgtgctggaggatgcaggctacaaggtcgctatcctcagccagccggatttccgcgatgagcacgattttctcgaaatgggccgtccgcgctatgcggtgctcatcaacggcggcaacatcgactcgatggttgcgcactacacctcggcgaaaaagcgccgctcggacgatgcctacacgccgggcggtgtgggcggaaagcgcccggaccgtgcggtaaccgtctattccatgcttgcgcggcgcgccttcccggaaacgccggtctatctcggcggcattgaagccagtctgcgccgatttgcgcactacgattactgggctgaccgtgttatgccgtccattctggaatccaccggcgcggacggcgtgatgttcggcatgagcgagcactcagtcgttgagctggcaaacaacctcaagcacggcaaaaagggcgcagacgcgtgcaagggagtccgcggcacggcctatatggtgcatgatacggacgatctggagtatgatgcggtcgaatgcccctcgtacgaggatgtctgcgccagcaagccggactacgcccgttcggtcaaaatccagtacgacgaacaggatgccgtgcgcggcaaggcgattctccagcggcacggcaaacgcatccttgtgcagaacccgcccgcaaagccgctgaccacagaggagatggaccatgtttacgcgctgccgtacatgcgtaactatcatccgtcgtatgaggcgctcggcggcgtacccgccattcaggaggtacagttctccatcatccacaaccgcggctgcttcggcgcgtgcaacttctgcgcgctcgcgttccatcagggacgctacattcaggtgcgcagccacgagagcgtgatcgaggaagcaaaaaagatcacccaaatgcccggattcaagggctatatccacgatgtcggcggcccgaccgcgaatttccgctttccggcctgcaaaaagcaggaaaaattcggctgctgcaaggacaagcgctgtctgttcccaaccacctgccagaacatcgaagccgaccataccgactaccttgagctgctgcgcgagctgcgccgtatcgagggcgtgaagaaggtgttcgttcgctccggtctgcgctacgactacatgatggccgaaaagaacgatgcgttcttccgcgaactggtcgagcaccacatctccggtcagctgaaggtcgcgccggagcacatgagcgacaacgccctgtactacatgggcaagccgtccttcaaggtgtacgagcagttccgcgagcggtatgcccgcatcaacgaaaagctgggccgcaagcagtatcttgtgccctatctgatgagctcgcatccgggtgcaacgcttgatgacgccatcatgctcgcgcagtacctcaaccgcgtcggctacatgcccgagcaggtgcaggatttttatcccacgccgggtacgctgtccaccgcgatgtactacaccgagattgatccgcgcaccatgaagccggtctttgtggcaaaaacgcccgaggacaaggcgatgcagcgtgcgctgctgcagtggcgccgaccggacaagcgcccgatcgtcattgccgcgctcaaaaaggcgcaccgtgaggatctcatcggctttggcagggaatgtctcattcgtccgggcagaggcagcgaccagcgcatgccgggcagcaagcagcacagcgtcagccgccacggcgtgtccaacggcggcagacagcagaataacgaccgccgtcattctgcgcctaataacggcaagcacagtgcgccgaacagcaaacgtccggcttcgcgtccggcacagggcaagccgaatcagggtaaaaaaaccggttgggcaaaaccgaaaaagaaaaaataattttatacggaactttttacgccgtctttcgtctatactatcagagttacgaaaggcggtgtttttttatgacaaaacgtactttagcaatgcttcttgcacttctggcgctgctgctgaccggctgcggcaatgccgagccgaaaaacacggaagccgaaatcggcagccagagcacggatgacgcagctgccctgccggataccaccgagcagacaccggtcgcagatgcacccatgatggtgatggtggataacacgctgtatcagtctaccggtgaggtcagcacggtcgatggccgctgcggcaacatggacggcgagatcacctcgcagacggcaaacggcacggacgcacccaccgagaacggccagtccaacttcggcacaggctacggctatcagcgcatagacgaccatatcgaggtgctgattgataaccagtggattgtgttcgagcaggatgccaccgtaccgcggatggtcatggtggatggcaagctgtatcaggagaccggaaacctgccttccgagccgttctgcggaacgcctgacggttcgatcacctcgaaaacggcaaaccgaaacgatgttccgaccgaaaacaaccagtccaatttcagcgataaccgggattttgtgttcattgacgaggataccatttacgtttccgcaacgccggactggatggaattcaaggtcatcaccgactcggatgtataaaaacttttgttcgaagccttattttatttgacaacaacccggtcgtgctttataataaacagtgaacaaaggagttcgtcccgcgaaggcgggtcggactcctgtttttatttttaggataaggagggctatttgccccatggacgaaattgatctgaagctcttgcggctgctgcagaagaatgcccgcacccccatcaaggcccttgcaggtgaggttcgcctttcctcccctgcggtttccgcgcgtattgagcggctggaaaaacagggtgttattcgtgcgtatacgctcgatctggacccgctgcagcttggccatcacattctcgcgtacattcatctggatatgcagcccacccagaaagaggaattttatccgttcattgctgcgtgctcgaatgtgctcgagtgcaactgcgtgaccggcaactactccatgctgatcaaggtgtcgttcgcctcgacgcaggagctggacggctttatcggacgtctgcaaaaattcggcaagaccgaaacacagatcgtgttttcctcgccggtgccgccgagagccattgtggtatgagaaaaagcctgcgtgtgcaggctttttcttttgtccacagggtgggggtagttttgatttatctgcttgctaaagcagcgggaatgggcgccaacctttggcggggaggttcgccgcatccgcggcgggggcaagagggtagacacctgcggtttctaccctcttaactcccgtttccctttatttgttcgtctggcgcagaccagagaccggtgaccgctcagaaaagaagaacggcagtcgagttactatggcgtatctttctctgcctattcgcagttcacagacagcgtactgctacacatgtgggttcatctatgcaggcgcgacatacccgtgtcgcgcaattcgtttgcacgttgttgtgcatggcacctgcgaatatttctttgcaaacacactttatcttacaagttcttcactctcaacgctccactcttcactctaattctcaattctccattttcaattctcaattactgagtttttccgccgcgagatctgccagtttcgcatactctgcaagtctcagccgctcaccgcgaacgcgggcatccagaccggctgcttctacgagtgcggtgatctcctccttgctcatcgacgagccgagcaccggaccgagcgcgttcacgagcgtctttctacgcatattgaaggctgcgcgcacgagggaaaagaacagcttttcgtccttggtctcaaccgtcggcttgtcgagcggcacgagcttgagcaccgccgaatccaccttgggtctgggcacaaagcagtccgccggaacatcaaacaaaatttccgccttggcgtggtactgcacataaatcgagaacgccgagtacgccgccgtacccggctctgcacagatgcgctgcgcgacctccttctgcaccatgaccgtcacctgcttgaacgcgccgctctcgagcagcgccgtaatcgccggtgtggtgatgtaatacggcagattggcgcacgcaatcgcctttccgtcaccgaatttctccctgcagagcgcggcaaggtcggtttcgagcacatcgccgtgcacgacctcgaagttatcgtaatccgcaagtgtctctgccagaaccggcatgagggcacggtccagctcgaccgctacgaccttatccgcgcgccggcacagctccgccgacaggcagcccatgcccgggccgacctcaatcgcgttgccgcactcggccgcgccgctcatctccgcaatgcggcgcggcacgctttcgtccgtcagaaagttctgtccgagcgatttagaaaaatggaatccgtgacggcccagaaccgctcggattgtctcaatatcacataaattcatttgttttccccttttaaccgaaaagaaccggcggcagaacgccgccggtccctatgtaatgcaacttttttactgtttgacgcggattttactcctcgccctcgatcagaccgtaaccgcctgccgcacgcttgtaaacaacggcgtggatattgtcgttgtcggcgttgcggaagaagtagaactggtggtcaagcaggttcatctgcaggatagcctcgtccacgctcatcggctttacgtcgaagcgcttgcggcgtactacatcgaaatcctcctcggtcagtgcggccttctgctctgccatcttgtcgaatgcaccctcacgcaggcgcttctccagacgggtcttatgcttgcggatctggcgctcgatactgctgatggcaccgtctacggaagcatacatatcagtcgtcgtttcctcggcgcggacaaccagaccaacctgacgcaccgtgatctcgaccgtctgcttgccgcgcagctcgctgaatgtaatcgtggtatccgaatcctgctggaagtagcgatccagcttctctaccttacgcagtgcgtactgacgcagctcgtcctcgatcttgatttttctttcgacgatagtgaacttcataaaatcatctcctaacaggcgtaaaccgcctttgatggctttatccgcggccgccgtggtgtggcggaaacggtattgggtttttgctatcttcagtatagcacaacctatgcaacttgtccaacaatttttcagaagttcacaatttgttcagcatatttcccaagaggttttacaatttcttgtcaaggttgcttacagctcgccctctgcgtgacgagtaacgtggcaggaaatattaaccacgcacggcagaccggcgatatgcgtgccaaacggctcaatcgcgcacgcaagagcggtaaccgtaccgccgagtccctgcgggccgacaccggatgcgttgaccttatcgagaatctgctgctccatctcggcgtacagcggatcggcgttgtgctgatcgaccggacgcagcagcgcacgcttggcgagatatgccgccttatcgctcgtgccgcccagaccgacgccgataacgatcggcgggcacgggttggaacccgcatggatgcacgcatccgcgataaaatccacgatctgcgccttggtagcggcaggcgtgaacatcttcatctgggtcatattctccgagccgaagcccttgggggcaaccgtgatcttcaccttgtcacccggaacgaccgaggtgtacaggatacacggtgtgttgtcgttggtgttttcgcggcgcagcggatcaccgaccaccgacaggcgcagataaccgtcgatatagccgcggcgaacaccctcggtaactgcatcctcgaacgagccgccggtcagatgcacgtcctgaccgatctccgcgaacacgatcgccatgcccgtatcctgacagaccggcacattattctcgcgtgcaaggtcgcagttggcgatcatttcaccgaagatggtcttgccgagcggagactcctccgcgttctgaccatccacgaacgcctgccgcagatctgcgggcagatagtagttggcgtcaatgcacagctgacgcaccagcttggttacttccgaaacctcaatcgtcctcattttgtcctcctatattccggtgtgccgtttacaaaaacagcctgcacctgggttgcaatatccagcggatcgccgctccacagcacacagtctgcgtccagaccggttttcaggctgccgattctgtcctgcatgcccgcaattttcgcgggtaccgaagtgaccgcgcgcagcgcatctgttttatccatacccgcgcgcaccgccagcataagcgccatcggcagcagccgcagcggaatttccgggtgatcgaccgtaatggcggtttcgattccggccttgcacagcagtccgggcgcggcatccgacaggttgcggatctccggcttggaacggtcggtcatgtacgggccgctgaccaccggaacgtgctcctcagccagcaggtcggccacaaggtgcgcctccgtgccgtgaatgataaccgcccgcagaccgaactccttcgcaatgcgcaatgcggtaaagatatcgtccgcacggtgcgcgtgaaaatgtgcctcggccttgccccagagaagcggctgcagggcttccatcttgatgtcgaaatccggctcgtcctgctccggatcgtcctccgcacgcgccttgcgcaagaaatactccttcgccttgtacaactcctcgcggatgatgcccgcggttgccatgcgcgtgacgggcgtttcgtccttatcgtggtagactgacttcgggttctcgcccagcgcgaacttgatcgccagcggcgccttgagaatcatatcgtccacacggcggcctgccgtcttgagcagcgcaatctgtccgccgatggggtttgcgctgcccgggctgacagccgcagccgtcacaccggcctcaagtgcctcgcggaagctgcggtcgaacgggttgacgccgtccaatgcacgcaggtgcggcgtcgccggatcggtgtcctcgttgccgtccgcgccctcgaagccgaggccgtcctcgtacagaccgatgtgcgagtgaatgtcgatcaggccgggtgtcagcacgccgccctcaccgtacacgacatcgccgtctatttgaaccggcattgcaggcggttcgccttcgcccatggacgcgatttttccgttttcgagcagcacccagccgtaaaagcgggtatcctcctcgtccattgtccaaatgtttacatttctgatcagtgtttgattcattcagaacctctttcaaaaaagctattgacatatatggtaatttatggtatatttatcatggcggttgggaaagccgccatgcaccgttcatatctttatccccacaatcctacttttggcgctctttcgcaaggaagagcgcgctttttttacgcaaaagcaggagttgcgctccttttcagcacaaagtatgccgggcacgcgagttgcgcagcaatacgccctgtccgggcagcaccttttcctgcaccgattgtctggtgcacacgaaccgcgcaggcggttcgcccctaacggacggtgggtttttcgctgaacctcagttggagtgcgccgcctacggcggcgggaacgtgccgcgccccgcggcgggggatttgcgctgacgccgcgcgggcgcacaagagggtagacacctgcggtttccaccctcttgtgaatcacccctttcccttggagagtctgacgcagattaccgacatgtgaccgctgcgaaataggggaacggcagaggagttttttctaccgcaggggagcacagtgtgctcccctgtcgagacatattcgcagggtcggctaccgtactgctacacaggtggtttactctacgcaagcgcgacatacccgtgtcgcgcaactctttaacgtgttataccggacggcacctgcggattaggcgtttgatactatttatcttcacaggtgctgtctatcacaaagcgctcacgaattgcgcgacacgggtatgtcgcgcctgctggaagtagccgacctgtgtagcagaacactatctgaccctgcgaataggctgcgaaagacacggaagaaaaaatcctctgccgttcccctatttcgcagcggtcacatatcggcaatctgcgccagactatccacgggaaaggtaggagttcaaagaggaaggaaaaccgcaggttgtccttcctttttgcccaccgccgtgggtacggcgtcgcccccgctgaggttcagcgaaaaacttcccgcccggaaagggcgaacccgcctgcggcagttcgcgcaccccgctgggtcggtgcagagaaggagccgccccgtcagggcgaacacgcttacgcagttcgtatgcaccggacagccggtgccgaaaagccctgccgacgcttcgtgcaccggcatataaaagcaaaaccgaggtttccctcggttttcttctttatctgcggcggcgcgaaccgttcttgcgatcggttgcgtggcgcacatcggcctgacggctttcgctgtccgacataaacgccttcagcttatcctcaaagctcatcgtggacgggtccttcggtgcctgctgcacacgtccacgcggtgcggacgaacgctggaaacgcggctgacgcggcgcaaagccgccctcacggcgctcctgtctcggctgacgcggctcctgcggctgcgccttcttgatcgaaagattgatacggcctgcctgatcaatattgatgatctttaccttgacctgctggccctcctgcaggaaatccttgatgtcgtttacaaaagtcgaagcgacctccgaaatgtgcaccatacccgacttgccttcgggcagcgcaacaaatgcaccaaacttggtgatgccggttaccttgccctctacgattgctcccactgccaaatccatataagctgttttgcctccgttattatttcccttttaccggctggacgtatctacaaaaatacgctcgcccggttccgcatagcccagttctgtccgcgccatctctccgatatcctcctcggaaatgccgctttgcatttcctgacggagcgtctcgttcgccttctgatattcctccacccgcagggtcagagacgcaagttcatcccgcttgctcttgatctgcgtgcgcaggtttaccacattgacgaccgcgtaaagcagaaacaccactaccgctgccctgataaggatcatccgcgtgcgccttgtcatctgctcacctcatatcgtttgcttgcgcgtcagactgatacaggttttattttataccttttttgcgaaaaagaaaagagtctttttcaaattttttcgtcaaaaaccgaatttttaccggactgcaccgctgttttaccaccgtttgacagtgcatccgcaggccgtatacggcgcgtctcagctttacaagcacctgcaggagcctcataagcacttccagcacggtttcgctcagcgccgcaaagtacaatcccatgccgcctgccgctgttaaaagcacaaagccgcgcggctgaccggcggccgcgatcagcccgaactcgaataaggccgccagcacgatcgcccagaacagcgtatcgagcagcgccgcccctgcccatccgcaccggaaatgcagacgcagtgcccgcagcatgtcatacaccgccccgatcccgacaccgagcagcaggctttgcagcacgagcgtgacctgctggctgttcgtaaacaccggcatggccgctcacccgccgaatatccgccgaaacaggctgtcgcgcggctgcacgctgtcgtcgtactcgagcagaccgatctcaccctgaatgatcagctctccggcctcgagctgcagccgctctacatgcagtccctgaccgcgcacgaccagcatgccccgcacggtttcgagcagcacctgttcctcatcaaagctgtgcacatcggtcacaccggaaatggtcagcttctctctcccctccagaatgacactgtgcggcatttcacggcttcgttcctcctgcgccataaactcccctcctgactgcaaaaaagtatcccactctgcaatatatgcgagagcgggatacgttatgttcggtttacagttccttatacagcgcagacgcatctgccttgagcgtatgctccgcgatattcagcacttccaccttcatcgtgcgctgaccgaatgcgatctcgatcacgtcgccgatcttcacctgatacgaagccttggccggcttgccgttgaccgtgatgcgcgctgcatcgcatgcatcattcgccaccgtgcggcgcttgatcaggcgggataccttcaaatacttgtctaatctcacttgtttccgtctaccttatctttcaaaactttgcccggcttgaacaccggcatagtggccgctgcaatattgatctcctcgccggtacgcggattgtgtcctgtgcgtgctgcgcgctccttggtctcaaacgtaccgaagccgctgatctgcagcttgtcaccggccgccatgatatccgcaatggcggtaaacacggtgtcgatcgtcttttcggtgtccttcttggaaaagccggtcttttctgcaaccagcgtcaccagttcgcttttcttcatggttttgctccttatgcgtgttcctcgtgctttgcgctgtcccacagtgcatccagctcggaaagggacaggtcagccagctttttgcctgcggcagtcgcctgacgctccatctccgcaaagcggctgacaaacttgttgcaggtcttttcggcggcagcctccgggtcgatcttcaggtgacgcgccacgttgacggacgcgaacagcaggtcgccaatctcctcctccggattgccgtcaccgtcgatggcacggcggacctcgtcaagctcctcctgcaccttgtcaagtgcatccttcacgttatcccagtcaaagccgacctttgccgccttcttctgcagcttttctgcacggatcagactcggcaggctctttgccacgctttcgagcgcctgcgtatcggtctcctgatgcttctccttgcgcttgaggtcatcccagttcctgaggacctcctcggacgaggcgacctcgacattgccgaagatatgcgggtgacggaagatcagctttttacagatgccgtccgctacgtcgtcgatgtcgaatgtgcccttttccttctccatctgggtgtggaataccacctgcagcagaacatcgccaagctcttccttcatatgctcggtgtcctcgtcgtcgatggcttcgcagacctcgtaggtctcctcgatgaagttgcggcggatagaatgatgatcctgctcacggtcccacatgcagccgtccggcgcgcgcaggatttccataatgcggagcagatcctcgaacttgtaacaatcctttatttcaaaatcaaccatttttgcacttcctgattactttagatgtaaaatatctgcgattttctcgcccttgggcagcagcagaacatcatcccgctcgactgcaccgagcgcgagcagcagaacggcatacacggcaaccgccacaccgatgcacgcgagcgtgatcagcttgtcaggcatggtgccgggagctgcgctcaacgcaccgttcagcacgcgctgcacaatgaaaatcgccgcactcatgccgatggtggccgccagcggacggcagaccgtttttccgatcggcggcagcgaacccgtcagacgcctgatgtggaacaggttgatgaccgcgatcagccagtagcagagcgccgtactgatgggcgcacccatgatattcagcgccggattaccgatgagaaaatagtcgccgagcattttgacaaccgcgcccgcaaacatcgagacaagcggcaggtcaatgcggccgaacgcctgcagcgtcgagttggtgacagccacaagtgccgccgccggtacggcaaagccgagcagacccatcagcacaccgccaagctccgttccctgcgagtacagcatgcgcagaatcggtccggcgagcataatgaagcccgcgccagccggcagggtgatgataaccgtcatgcgcagcgtggtacccagtgttttggagaccttggcatggttgcccgccgcgcgtgcgcttgcgatggtcggcagcacgctgaccgccagtgcggtgatgagcgtctgcggcaggttgaagaagttgatggcctgaccggtgtaaatgccgtaggtggacattgcttctcttgccgtcatgccgaccgccggactttgcagacgcgtggagatcagcgccacgtcgatcaggtcggtcagactcataaccgctgagctgatcgtgatcggaatggacagactgagcagcgttttcgccagctggcccgccggacgcacgctgtcgtccagcgcgtgcactgccgaactgctgcgatgcgtgatcgctccctgaatgagcatgtaaacagcggcagccacctcgccgatggtaacgccgaggacggtcattgccgcgactgcctgatcagaaaagttatgctgaaccgcgtaatacgccagtccaagaccgataaacagcttgccgagtgactcgatcacctgcgaaaccgccgtcggcaccatgttcgagcggccctgatagtagccgcggaacaccgccagaacagcaaccatcagcacgctcggtgcgatggccataaccgccagccgggaatccgcgctcttgatccaggatgcaaacgtgcccgcgccgaggaacagcacgaccgagcagaccgcaccgagcggaatgaaaatgcttcccgccacacggacggtacgccgcacctcatgctctctgccgcgggctgtggcctccgcgaccattttcgccagcgccgccggaacaccgacggtcgagatcatcagcatcgccgtgtacacgcggtacgccgcactgaacatgccgaacgccggcgaatccttgccgccgatcatgttgagcagcggtatctggaagaatgcgccaatcaccttgacaagcagactggccagcatcaaaatgaacgcaccttgaatgaaattctgttttttacgctgcaaacgccgtacgccccttcctttgatcagaatgggcatagctgcccttgcccgatattacaatatgatgcatcaaaccgtattatgttacagctctgcgccgcaggacgagcagtatgcgtcatccttgccgcacggtttgccgcagtgcgggcacgccgttaccgagcgcatttccgccagcttgtcgcgcagcgcagctagcttttcctgcttggcatcgacctgcgccatcttttcgtccatttcctcgttggtgacctctgcgccgcggtgcagatcgtacaccagcttgccgatttccttgtacagtgcttcgcactcggtgttcagatcgaaaatctgcaggttgatgcgggtcgccagtgcaaggtcgttcgcctttttgccggctacgcctgccgcatgacgggagaccttgccggttttatccgccatgtcctttaccttatccagaaaagcctgcattttcatatccatagcttgtcgctccttccgacggaatgtctccgtttccggtctcatggtaatattgcgtaatggaacaagggcgatttgcgggaaaatttccgcaaaacgccgcagtttcaattatgtggtattgccattatacttcataccctgccaaaaagcaagaatccggacatttttcagccgataaactcatgcagaaccgaatcctccggcatatacggcttgtagtcgatcggcgaaacccgatccaaaatcgcgctgagcggtgcaaggtcagcctgctcgagcattttctcctcaccctgcagcttttcgctcaggtactgcatgaggatgttggtctcgtacggcagataggtgtccaccgtaaggtcagcctgcccgcggtacggcgaaatatacagtctctcgcctctccgcaccgagttccactgctttaaggtgtgctccaccggcgaactgcggaacaggctgtcgcgcatggcgcggcgcaggaagcgcagcatgtgcggctcaacgcggacgttatggtcggtcagcagcacgctcgccaccgaaagatagacgcttgtcgcatgcttctccagatcgcccatgatgaccggattaaacgcatgaatgccctcgatcatcacaatttcgtccttgtgcagctgcaccgcacgctcgttgcgatgcgaggtgcgcgtttcaaaatcaaagcgcggcacgaggatctcctcgcctgccaccagacgcgtcaggtggtcgcggagcagatccagatccatgcactccgggctttcgagatcattgacgccgttttcctcgtcaaacggaatatcgtaggtgcccgaggtacggtaatagtcgtccatcgagatcatgtgcgcgtgaatgcccgccagctcgagaatgcggcccagacggtcgttcgtagtggtcttgcccgatgaggacggaccgttgagcagcacgaccggcttgcgcttgcagttcgcagcgatctggtcagccaccagatgcagctgacggtgatagtgctcctcgcagtcgttcacaaaggcttccgcgtcgcattcggcacggtggttgatgtatttcagtgtgtattctgccatagccagtcccttcttacggaattactcactcatttccctatcttgatcatttcttggggaacagcagctttttcttgccattggccagtctgtccgccgcctgaatgtactcaagcggatatttcggattgttcgcgcgctcgatccagccggtctcgcgcacgacacgcttggaaacaccgcccgcaccgagcgacagaatggtctgcagctcctccatcatgctcacgttgtagaagcattcggtgtccggcttgcaccagccgacgttctcaaagccgcctgccataaatttctgccgatagaggtagtatggaccgtagcctgcgttctgcagcgcgtgcgatgctccatccagcatttgagaaacggtctcgcgctgtgcggcggcagccgccttatcggtcagatcagcgccgcgcttgatggcgagcgtgtgcaccgtgatattctccggcgaaagattcagcaaagtatccacagtctgtgcaaaagtctcggcagtgtctccggtcagacccgcaatgaggtccatgttgatctcgtcaaaacccgcctgccgcgcctcgtcaaacgcgcggagcacgtctgccgagccgtgttttctgccgattgcggccagaacggcgtcattcatgctctgcgggttgatgctcacgcggccaacgcccgcgcttttgagcacgcacagcttttccggtgtgatggtatccggacggcccgcttctacagtatattcgcgcaaatgtgaaaaatcaaagtgattttcgagcgccgacagcagccgtgccagctgatgttcgtccagcgtggtcggtgtgccgccgccgatgtagacgctctgcacctgcttgcccgctgcgcggacaagcgcggctgtctcctcgatctcgcggcagagcgtgtccagatacggctcgatgagtttaccggactgcgctgtggttgccgatacgaacgagcagtaatagcacctcgacggacagaacggaataccgacgtacagcgaaatatcgttttcaccgatggtcttgtccatctccatcgcggttgcggctgcacgaatcgtcagcgccgtgcgctcgggcgaaacgtgaaagtgctcgcgcagctcgaccgccgcctcgccgcgcgtcatgccgcgctcgatcatgccgcgcgccagcttggccggacgcacgccggtcaggctgccccagaccggagcctgcggcagaaacggcacgaccgcgtcgtacacggtcgttttcaccagttcggtgatggtgcgcttgtagtccagcgtttccagtccggtaacggacgcgcgcttttccgcctcatgcactgcgccgtccatgcagacgatcgcacgcgcggcggcttcgccgttctcctcggtcaggatgctgcggcagtacggctcggtgatctgctcggcggtgtccgccctgctcagcgtttcggtcggcagcagatgaaacagcatttcctctaccgcgtgtttcagttcgtgattttccagtgtatagatcattttcccatcgcctgcagcatatatggattgtatgcgcgttcctcgttcagcgtagaaatgccctcgtgaccgggaaataccttgtaatcgccgtcaaggtcatgcagacgcttcaaagagcgcagcatggcagagaaatcgccgccctcaaggtcgcagcgaccgcactcatgacggaacagcgtatcgccggtgaacaggcagtcaccgatcctgataacggacgagccgggcgtgtgaccgggcgttgccatgtagattgcggtcataccgccgaacgtcacctcggtgccctcattcgccagaatatccggcgtatcctgcacataattgcgtgccagtccgcggaactgacccatgttgtcgcggttcagcagccaggtgtccttctccggcacaacatactgtgcgccggtggcttcgagcacctcatgcgccgccaaaatgtggtcaaaatgcgcgtgcgtgagcagcacatacttgacgttcagcttttcctcatttaccgcgtgcaaaatcgacttggcattgtcgcccggatcgatcaccgcggcttcgcgggttgcttcgtcatatacaatataacaattcgtgcggaccatgcccacacagagttgcattaacttcatcagttataccctttcttcggcatttaagccttcttcgtagggcgggctgccctcagcccgccgtggtaagtcagtgtaaattgttttatttcgcagggtgagggcagaaggtaaattgccgataggcaagagaagccactctggagtgccccgccctacggaacaggtttatcttgtcaatgccgcatatccttagtgtccatccacagcgttaccgggccgtcattcaatagatcgaccttcatatccgcgccgaactcgccggtttcgaccggcagcccgctctcgcggcagcgcgcaatgaatgcttcatacagcgggatggcggtttccggacgggcagcgttcgtgaagctcgggcggttgcccttgcggcagtcaccgtagagcgtgaactgcgacacgatgagcaagccgccgccgacatccgcgagcgagcggttcattttgtcgttttcgtccgtgaatacacgcattttaaccgttttatcggccagataaaccgcatcgtccacggtatcaccgtctgtgataccgagcaggacaaggaagccctgtccaatctgtccgtgaatcctgccgtcgatcgtcaccgacgcgtgggagactcgctgtaccagcgcccgcatagttatttcctcttttcgtagtaagttttgaatttaatctgttgatttttttgatttggaatgggtgccaaaccttggctggggttccaaaagggtagacaccaatggtttctaccctcttgggactcccgtttcctttttgggataccttgagtgcagatggtagacttcgtaagcaggaaaggaacggcagaggattttttcttccgcatggtatccacttattcgcatttcggataccgtactgctacatccaattggggtctacgctgggcgcggcatagcagtgccgcgcaactcctttgatgataccagttagatacatcgtggggctcgatgacccatcgagcctttttaaaccttctgcaccagccaatgcctcccccttttaggggagcctgaaacgcgcaggcacaagcgctttccgcgtctcattttccattctccattctcaatcatcaattatcaattcgtatccaccgttctggtcacatcgacaacgcccttgatggaacgcaggcggctgatcatattatccagctgatggacgctcgtgacgtcaaccattgcgttgataacaccgtagccgtcgttgaggtcgcgtgcggaaatctcatgaacgttgatcttactcgaggcaaacgccagcgtaacgtcgctcagcacgccgatacggttgcgcgtggaaatctgcagaccagtggagaacttattgacatgaccggcattggccgccatatcctcatcccaccaggcacggacccagcggtcgggttcttcctcgatatggacattcacgcagtcgcggcgatggatggaaacaccatagccgcgggtgacaaagccgacgatctcatcgcccggaatcggcgtacagcagcgggcaaacttgaccagacagttatcaatgccttcgacaacaacgccgtcgctggatttattctggcggcgctgctgctgctcattctgcggatgtgcggcacgctctgcctgctcgcgctggcggcgcagcttgccgacatcgtccttaaccttattgatgaccttggtcagcataatgccgccgtagccgatagccgcgtacagctcatcgaccgtgttgaacgagaacttgttgagcgtgttcttctgcacctcttcgttctcatagaagccgttatacagcagattggcacgcagctcgcggtcgagatcctccttgccgttgacgatattttcctcgcggcattccttcttgaaccactgcttgatcttgttgcgcgcctcggtggtcttgacgatcttcacccagtcacggctcggaccgtgtgcctccttggaggtcaggatctcaacgatatcgccgtttttcagctgactgtcaatcggtgcgatacggccgttcagcttgcagccggtcatgcggttgccgactgcagagtgaatcgcatacgcaaggtcgatcggcgttgcgcctgccggcatattgaccacatcgcccttgggcgtaaagacgaatacctcgtccgcgaacaggtcaaccttgatgtttttgataaagtcctcggcctcggtgtcctgctgggcttcaagcagctggcgaatccacgcaaacgcttcctcgttgcccttcttatccagaccctgcttgtacttccagtgcgccgcaacaccgtattccgccattttatgcatctctacggtacgaatctgcacctcaaacgggatgcccgctcggccgatgaccgtcgtatgcagcgactgatagccgttcggcttcggtgtggagatatagtccttaaagcggcccggaatcggcttgtacaggtcgtggacgtagccgagcacgttgtagcagtccgccacggtatcgacaatgacgcgcacggcgcagatatcatagatctcgttgatggtcttgtgctgggcatacattttgcggtagatcgagtaaatatgcttgacgcgggccgaaatcgcgttgtggatgttcgcttccttcagcttggtgctgatgcggtcctgaatgccctgcagaaattcctcgtgctgctcactctgggcctttaagccttccacaatctcgttatagccgatgggatcgaggaccttcagggacaggtcctccagctcccacttgatgcggctcatgccgaggcggtgcgcgataggcgcgtagatctccatggtttccagtgccttgtcgcgctgcttgcgctcaggcaggaactgaaaggtacgggcattgtgcagtcggtcggccagcttgatgaggataacgcggatatccttcgccatggcgaggaacatcttgcgcaggtcctcgaactgctcctgctccttggagtagcgcagcatgcccagtcgggttacgccgtccaccagctccgcgaccggcgtgccgaatttgttttcgatctccttgtagccgaactcggtgtcctcaatgcagtcatgcagcagcgctgcacagatggaatccgtatccagccccatctccacaacgatctcggcgacagcgaccggatgaatgatatacggctcaccgttgcggcgcttctgtccctcatgtgccttggccgcacattcgtatgccgcgcgaatcttcttgatattcgcctgcgggttttgtttttgtacgcgttcgatcaaaaaatccagtttcgtttgcatagatccttcccccattcgtgtcaccccgccatgctttgcaatgtggcaaggacaaccgatccggaaatatcggccttgccctcgtagggtttgagcaaaatgttgagcatgtcttccttgaaatgatagctgatgagtccggactcctgaaaaacgtccagacagacaaacagcttgccgatgttaatgtcgcgtcggctttcccacgcaacccggcgggaaagcgccccgtccggtacggaaagccgtccgtcctccgcgcggcaggtcacatgccgccagacagcgaccagatccttgcggtcgggcaggagcagacgcgcttcccttgcggtgagcgggccgtcctgcatgagtgtattatacagattgagaattttctgatccgccagatgctcacagtcactcagctgcacatcgcagatggtcagctgcaccgagcggcggcctcgaaattcgttgatctccagatgaaaggcggcatccacggtgttgccctcgacaaagccgagaccgcccgcaccgatgccgaaccagatcgcggaaaaccgcttgccgtccttgatgagcgacagacgaacatgccggtcgctggacagcggcgtaatctcctcaacggtcatgttcttcatgcagaacacaggctccgcatttttcatgccgtacggctcgagtacgctcagggattcgatgttctcctgcgtcagccactccgactgcaccatgcagtcgatgtgcagctgcggaacgagctccgccatggtgacatgtgtttccgcgtacttgcgcaggcgcgtgcggagttcttcgatcctgtccgcctgcacggtcagtcctgcggcaagcgcatgaccgccgtagcgctcgaacaggtcctcgcacgaggtgagcgcctcaaacagattgaagctgccgatcgagcggccggagcccttgcctacgccgtcctcgtccactgagatgagcacgaccggacagccgtagcggtcgcacagccgcgagcacacgatgccgatcacgccctgatgccagccctctccggccagcacgatgatcttatcctcaagcgggttgtattcccggcgcaaacgcgtgagcgtctgctcgagtatcttgttctcctcgttctggcgcagcttgttttgctcgcaaagctcagcggcaagcgcctgtgcccgtaccggatccttcgtcaggaacagctctgctgccagctcagccttgcccatgcggcccgccgcgttgatgcgcggcgcgagcacatagctgatggtcgaggaggtcagccgcctgttcttcatccccgcctcgcgcagcagcatttccagaccgatattcgccgtcacggacagctttttcagtccttccgccacaataatgcggttttcaccgacaatcggcatgacatcggccaccgtgccgagcgctacaaggtcggcgtaccggtcgagcatggaaagcgtgtcgccctcgagtgcgcagatcagcttgaatgccacaccgacacccgccaggctggaaaacggataggtatcatccgtccgcttgcagtccacgaccgcctgcgcatccggcaggttttcgtggcactcgtggtggtcggtaatgacgacctgcatgccgagctcgcgtgcgacggcaatctcctcgttggctgtaatgcccgagtccaccgtgatgagcaggcgcgtgccctgctcatacagctgctccatcgccggacgggtcagaccgtagccgtccgtcagacggttgggaatgtaatattcacattttgcgcccttgctgcgcagataatccaccagtgtgcacgttgccgtgatgccgtctacgtcgtaatcaccgtagaccaccattttctctccgcgatctattacctcgcggacgacctcgactgccttatccatatcggtcagaccgaacggatcatgcagtccgcgcacatcgcagctcaggtaatccgccgcagcctgcggtgtgtctatgccgcgcgccgacagcaccgccgccgtcagcggtgtatagccggtctcccgcgacagcacccgcacccgctcggtgtccggcgaggcgatcacccatcgctttgctctcatattgaacgatcccttcctgagtcacagcaacagcacgccttccggcgtctgcgtatggtaactccgattttatattatcactattataccaaaacacgcccaaaatcacaacatttttatcgaatacagaaaaaacaggtgtctcgctaagaaacacctgttttattacacatttcgactttatttatcgcgttttccgccgtttttgcgggcgaggatcggtccgagatactgtccggtatacgaacccttgcactgtgcaacctcctccggcgtgccggaaacgaccagtcggccgccgccatcgccgccctcgggaccgaggtcgaggatataatccgccgttttgataacgtccagattatgctcgatgacaacgaccgtgttgcctgcatccaccagcttctgcagaacatccacaagcctgtggacatctgcgacatgcagaccggtggtcggctcatcgagaatatagatggtcttgccggtcgagcgtttggacagctcggtagccagcttggcgcgctgcgcctcaccgccggacagcgtcgtggaggactgccccagcttaacatagcccagaccgacctcgcgcatagtctccaatcggcgtgcgatcttgggcacgttggcgaagaactcacacgcttcatctaccgtcatatccagcacttcatagatatttttgcccttgtagcgcacctcgagcgtttccttgttgtagcggcggcccttgcacacgtcgcacggcacataaacatccggcaggaagtgcatctcgattttgagcaggccgtcacccgagcaggcttcgcagcggccgcccttgacattgaaggagaaacggctcgggccgtagccgcgcgccttggcatccgccgtcttggcaaacagttcacggatgtcgttgaacacacccgtataggtcgccggattggagcgcggcgtgcgtccgatgggcgactggtcaatgtcgatgaccttatccagattctcgatgccgatgaattcgtcgtgcgcgccggctcgagtcttcgcgccgttcagctccgctgccagctttttgtacaggatttcgttgacgaacgaggacttgcccgagcccgaaacaccggtcacacaggtcagcgtgccgagcggaatcgtgaaatccgtgtgcttgaggttgtttaccgcacagcccttgaccgtgatgctcttgccgttgcctttgcgccggatttcgggcaccggaatgaattttttgcccgaaaggtactgtccggtgatggatttgtcgcttttgagcagctcgtctatcgtgccctcgaacacgacctcgccgccgttgcggcccgcgcccggaccgatatccacaatgtggtcagctgcaaacatggtgtcctcgtcgtgctcgaccacgatgagcgtgttgccgaggtcacgcagccgcttaagggtcgcaagcagcttgtcgttgtcgcgctggtgcagaccgatggatggctcgtcgaggatatacagcacgcccatcagcgatgagccaatctgcgttgccagccggatgcgctggctctcgccgccggacagtgtgccggacgagcgcgaaagcgtcagatattccagtccgaccgactgcaaaaagccgagacggcccataatctccttgattactctgtcaccgattttgtgctgcatttcggtcagcttgagcgtgtggaggaactccatcgccttgacgaccgacttttccgcaaactccgcgatattcagtccgccgagcgtgaccgccagcacctccgggcgcagacggcggccgtggcacgccggacacggactttcgctcatcacctcttcaatctcgccgcgcgaccactcactgttggtctcgcggtagcggcgttcgaggttcgggataatgccctcgaacggctggcgcatcacgccgcccgaaatgcggctgaccgacagctcgagcggctcatctccggtgccgtacagcagctcgtcgagtgcctgctcggagaactcctcgatgggcgtttccagcgtaaagccgtgctttttgccgagcgcgttgtagtacatcgccgcgatgctgcccgtgtcggcactcccccagccgggcgcgcggatagcgccctgcttgatggaaaggtggcggttcggaatgacgcggtccgggtcaacgcgcttctggatgcccagaccggtgcacaccgggcacgcgccatacgggttgttgaatgagaacattctcggggtaagctcttcgatggaaatgccgcagtcgtcgcaggcatagttctgcgagaacgtgagcggttcaccgccgataacatccgcgatgacaaggccgccggacagcgccgaggcggtctccaccgaatccgtgatgcgcccgcgggcatccggacggatgacaacacggtcaacaacgatctcgatgttgtgctttttcgtctttgccagcttaaattcttcggacaggtcgtgaatctcgccgtccacgcgcacgcggacatagccctgcttgcgggcgttctcgaacaccttaacgtgctcgccctttttgccgcggatgaccggcgcgagcagctgcacgcgcgttttttcctcgagcgccatcagccggtcgatgatctggtcgatggtctgctggtgaatctccttgccgcatttcggacagtgcggcgtgccgatgcgcgcccacagcaggcgcatatagtcgtagatctcggtgaccgtgccgactgttgaacgcgggttctgtgaggtggtcttctggtcgatggagatggcgggcgacagaccgtcaatatagtccacatccggcttgtccatctggccgaggaactgccgcgcgtagctggacagcgattcaacgtagcggcgctgaccctcggcgtagatggtgtcgaacgccagcgacgatttgcccgagccggacagaccggtgaacaccaccagcttgtcgcgcggaatcttgatgtcgatgtttttcaggttgtgctctcgcgcacctttaacgtgaatgtattcctgcatttttattttcctttattgttacgcataacgggttgagtaattgaaaattgagaatggagaattatcgccgcaaagcggcgcacctcgtcgcagcacggacggaactcgcgcaagaatagcgacattttccattttcaattctccattatccattttcaagcgccttaatctgatcacggagctgtgccgcgatctcaaactcgagcatcttcgcggcctccttcatctggcgggtcaggcgggcgatctcctgctgtttttcgcccttgctgcgcagctttttcttgctgctcgagggcacattcgaggtgatctcgataacatcctgcacctttttatgcacagacctggggataattccgtgtgccttattaaacgcatcctgcagcgcacggcggcgctcggtctcgtccatcgcgcgcttcatcgagggcgtgatgctgtccgcatacagcacgaccatgccgtgctcgtttcgggcggcgcggccgatggtctggatgagcgaggtttccgaccggagaaagccctctttatccgcgtcgaggatggcgacgagcgacacctcgggaatatccagaccctcgcgcagcaggttgatgccgaccagcacatcgtacacgccgagacgcagatcgcgcaccagctcctgccgctcgatggtcttaacatcgtggtgcatgtagcgcaccttgatgcctgcggtttcgaggtaatcggtcagatcctccgccattttcttggtgagcgtggtgaccagaacccgttctcccttggctgtgcgggcgttgatttctccaatgagatcgtcaatctggccatcaaccggacggacaacgacctccggatcgagcagaccggtcgggcggatgacctgctcgaccacctgacccgagcgcgacagctcatactcagcaggtgttgcggaaacatacacaatctggttcagacggtcgttgaactcgtcaaaattgagcgggcggttgtcatacgcgctcggcaggcggaaaccgttctcgaccagactttccttgcgggcgcggtcgccgtggtacatggcgcgcacctgcgggagcgtgacgtggctctcgtccacgataagcagaaaatccttcgggaaatagtcgatgagcgtgtacggcgcacttcccggcgcacgccgcgacagcacacgcgaatagttctcgacgcccgagcagaaaccgatctcctgcagcatttcaatgtcgtagcgggtgcgctgcgcgatgcgctgtgcctcgatcagcttgccgttttcctcgaagtattttacgcgctgttccagttcttcttcgaggtccttgatggcctcctccagcttttccttgggcgtgacgtagtggctcgccgggaaaacagcaatatgacccagttcaccgagcgaaacgccggtcagcgggttaatacggctgatgcggtccacctcatcaccgaaaaactcgatacggacaacatcctcatccgagtataccggccagatttccaccgtgtcgccgcgcacgcggaagcggttgcgctcgaacgcaatgtcgttgcgctcgtactgaatcgcaatcaggcggcgaatcagctcatcacggctgatctccatgcccggacggatggaaatcaccatgcttttgtagtcgatcggatcgccgagtgagtaaatgcacgacacggacgacacaatgatcacatcgcgtctctcgctcagcgccgaggtcgcagagtggcgcaggcggtcaatttcatcattgatggcggaatccttctcaatataggtgtcggtcgaggcgatatacgcctccggctgatagtaatcgtagtaggatacgaaatattctaccgcattctcgggaaaaaattcgcgcagctcggtgcagagctgtgcggccagcgttttattgtgcgcaagcaccagcgtcgggcgctgggtctgctcgatgatgttcgccatggtgaacgtcttgcccgagccggtaacgcccatcagcgtctgctcggtcagaccgttgttgatgccctccaccagtttggccaccgcctccggctgatcgcctgccatttggtaggggctgtgtatcttgaaatcaggcaaggaaatagacctccctctttgctcttagcgtgtgcagtaattgagaatggagaatggaaaatggagaatgaatgtgcgccgcacagcggcgtatcaaattccgtgctatgcacggttccttaattctcaattctccattctcaattttccattacttcgaccgtttacaaatcagtaccgttttcttaggcttccgcttctcagtctgccgatagatgtgaaattgctgcgtgccacaacgcagtgatcgaccagctccaaccccagttcggagagcgtgcgctgcagacggtcagtcatatcaaaatcctcctgcgagggtgtcggcgtgccgttcggatgattatgcgccagcgcaacgcctgccgcaccgaccatcaaggcaccgcgggcaatcttgtagctgtccacctgcacccgcgcatgtccgccgcgtgcgatctcctcgcacttgagcacacgtcccgcgccatccacataggcggccagcagcacttcctcccgctcggcgcacagctgcggcacgaaatacgcgccgatacggtcataggtgttcaatttatcggtaaactgctccattttcgccacatccgcctgataacggtgaaacagggcaaagcacaggtgcagcagctccgccgagcgcggaccgacgccttcgaccgtctgcagctcgtcctcggttgcctcgagcaccgcatgcagtgaaccaaaccgctgcatcagccggtgtgctgtcgggttggtgtcgccctgccgcaccgcaaaatacagcagcatctccagcacctcgtggtcgctgaagatctccagtccgaaccggcggaatttgtccagcatgcgctggcgatggcccatgtgcgggttgtccggcatctgtattccctccccctgtacaaaattgagaatggagaattgaaaattgaagattgaaagcagtatcgcgctctgcgcgattgttaatacgccgcttcgcggcgtttccttaattctccattatccattctcaattctccattaaaaatgaatcttctccaccgcctgattgagcgctctggttaccagtggactgtccttaatctccgggaacggaacggtcggctgcggtgcgccgtcatgcggacgcaggctcttgcccatccagaggacatcgcgccactgaccgaatttatacatgctctcctgatatgcgcccgagatgataaagcccatggctttatggaacttcatcgaccgctcattcggtgaagtgatgccgacgtagatattatagtatccctgcatcgccagcagttcaaacagcgcagcgtaaatcgcaccggcgataccgtggcggtgctgctcctgtgcaacgtagatagatgtttcgaccgaccactgataggcggcgcgggtacggtgcggcgcagcatagccatagccgacgacctcgccgtcaatgcggcagaccagccacggcagcttttgggtataggtgcgccaccggcgggtaaactcctccattgaaggagcatcgtactcgctcgacacagtggtttgaacaacatacggcgcatacagcgcaagcatctcggcaatatcttcttcctctgcaggacgcagaacaacttccggcatgattttttcctcgtttcgacataatctcgatataagtataccgcattcattttttatgttcaataggagattatcaaaaaatcgcacatttgttcgccttgtatctgctgatttttttacagtataattcttgccgttctatataatattctttgtcatttcagccgattgcattttgccttgccgagtagtatactatgaaaagcactgacgaaaacggcgtttcgccctgccggggaagagaaggaggcatcgcgcatatggttcgctacggttttatccataccaaagaggatatcaagtttctggtcctgttcgccatggatctgctgccatttccggtcagcttcagcaccattgtggacttaacgacctggtgtgacgaaggctttggctacttcgagctgagcgaggctttctacgagatggtcccgaccgggcacatcgaggagatacccgacgaaggagaaaccctgtacgccatcaccgaaaagggacgcgaggctacccgcattttcgagaagcagcttccctatccggtccgtgaagccgcacagcgctctgcgctgcgtgtcgtccgccagatccggcgcgacgccggcatccacaccgccgtcaccgagcacggcccgaacgacctgaccgtccgcatggaaatggagcaggtgtttgcagtggaaatgaacgtcgtcagtcacggacaggctgccatgctcgagcgtacctttaaggaaaacgccgaggccgtctaccagacattgctcaccgcaatgaccaaaaactacgcaaacgagaaagaagcgcaaaaaccttgaaacacatgaagcaactcggtgtgctgcttgcctgctgtgtcggcggctcactgctctcccttttactccgcggtctgctgcccggcaacgtgctcggtctgaccctgctgctcgccctgctcatcttcggtgcggttcgtctgcaccatgtagagagcgtagcggattttctgctgcagaacatggcatttttctttctgcccgccatgctgggcgtgctggaaatctggaacgacatcaaaagcgaagcactcgccatccttgccgtctgcctgctgaccacgctgtgtactgccgctgctaccgcactgaccgtacatatcgtgttccgtctgcagcaccgtgaaaccgaggaggcgttcgaccatgactgatcttctctcctcctcgcagttctggctgctggtttccatcggtttttatgcgcttggcgtagagattcaaaagaaaaccggttctgcggtctgcaatccgctgctgattgcctcgattctggtcggtgcgctgctgatcgcaaccggcaccccctaccagacctatgaggaatccggcaagctgatctcgttcttcctgacaccggcaacggtagcgcttgcgatcccgatttaccgcaagctggatgtactgctgaaaaacctgctgcccatcctgctcggcgcgttcgtcggctcgatggtatccatcggcagcgtactgctcttcagccatctgttcggtctgagcgaaagcacgacgctttctctcgtgccgaaatcggtaacaactccgattgcggtcgcggtagccgaaatgctcggcggcgtaacctccatcaccgcgattgcggttgtcatcaccggcatcatcggcgcgatcatcctgccgaccttcctcaagtgcatcggcgtgcgcaatccggtgcagatgggcctgtccatcggcacggcctcccatgcggtcggtacctcgcgtgccattgagctgggtgagaccgaaggcgcgatttccggtctggcgatcggcgttgccggtctgctgacggcacttatcgtgtcgattggctcggctattctgttataatcgaaaattgagaatggaggatggagaattgtggtatcgcgcattgcgcgatgattaaatcacggcgctacgcgccgcaacattcattctccattttcaattatccattctcaattcacaaaaccacctttcccctgcataagatgcaggagaaaggtggtttttctatggtgatccatgttgttcagccgggcgattcgctgtaccgcattgcacagctgcacagtgttcccctgccgttcctcatccagcagaacgagctgcacgagccgtaccggcttacgcccgggcagaccattgtcgttccgcagccggaaaagacgtacatcgtccgccgcggcgacacgctcggcagcattgccgcgcagaacggcacaaccgtgatgcagctgtggcagaacaatccgcagcttggcggcaccgaccgcattcagccggggcaaatgcttgttctcagctatggaaacaagctgggacgctttgcggtgaacggctacgcctatccgagcattgacctgcgcgttctgcgccgcacactgccctatctgacgtacttatccgtattttccgtcggttttgacaacgcaggacgcattttaccgttctctgccgagctgctcgtgcgcatggcgcggcagtatcaggtaaagcctttgctcgtgctgacaacactcggcgaggacgggcaattctccggcgaacgcgcccaccggctgctgaacaccccgacggctcgcgcggcgctgattgaaaatctggcacaggtgcttgccatgcagggcttcgccggtgtggacattgatttcgagtatgtgccgccggaggacgcggacgcgtatgccgcgtttgtccgctcggtccgcgagcggctctcgcctgccggatacacggtcttcgcggcactcgcacctaaaacctccgccgcgcagcaaggtctcctgtatgaagcgcacgactatgccgcgctcggctctgcggcggaccgtgccctgctgatgacctatgaatggggttacgcgttgtccgctccgatggctgtcgcgccgattaacaaggtagagcaggtcgtgcggtttgccgtgtcgcaggtgccgccggataagctgttcatgggcatcccgaactacggctacgactggacactgccctatgtgcagggacagtcgcgcgcccgcagtctgggcagcgtgcaggccgtcgagcaggcgattcaggtcggtgcgccgattcgctatgatgccacggcgcagtctccgcactacaactattggcgcgaccgtgccgagcacgaggtctggttcgaggacgcgcgttctgtccgtgccaagctggcgcttgccggagaatatcagctgacaggcgtcagcatctggaatattatgcggtattttccgcagctgtggcttgtgctgaacagcctgtacgacatcgaaaagctgggataaaattgaccaaaccgaccgagttttccctgtttcggtcggtttttgccgtattccggcagtttctccttggatttccattgcaaaacggttacaaaacccgctatcatacggtgcatgggaatttcccgcaaaatccaaagaggtacctacctatgaagttcaagagactcgtgccgctggcactcgcgcttgccatcgcatccaccaccgctgcagaagccgcacgtctgccgcagaaccgcttttcgttcgccgtgcgtccgagttacacgcagacggtcagccgtccttctgcgagcaagcccttacagagcactgccgcgaacagcagctacgccgcgcaggtggtctctctggtaaacgccgagcgtgccaggcagggactgcccgcgctgaccgtcagcagcgcggtgcagcaggcggcgcagacccgcgccggagaactgcaaaccagcttttcgcacacacgtccgagcggcgcatcctgctttaccgcgctgaccgaggccggcgtttcctacgcgcgtgccggtgaaaacatcgcctatggtcagagcacaccggaggctgttgtccagtcgtggatgagctcgtccggccaccgcgcgaacattctcagcagcagcttcaccaccatcggcatcggctgtaccgttgtgaacggaaccgcatactgggcgcagcttttcactgcataaacgcaaaacagaccgcatttgcggtctgtttaggctgtcgcgaaactacagtttcgccgacaagcaggaacggaccataggccgttcctaagtcgtccaaaagttcccatacggaaactttttccctcttaaggtataaaaatcgagatacacgctcccggtttttatgaatttgcaaagcaaattctatttaacgcgcgctgccgcgcgatatgataagattggttcaatactgacttttttgacaagctgaaacagaccgcatttgcggtctgttttgctctatcctgccgtttatcacgagagcggatacacctcgccgttgatggtaacggactgcacattatccagatcaaacgcacgcgccagcacggcaatctcggtgtcgatacggtcggtatcctcagtggaattgaagccgtaggtatacagagtacggtcaatatccgcattttcgtccagaataacgtactccgagccatccctcagctgcacgctcagcttatcgacctcgtccaccgtgcagtgcatatctgcattgcggatgcggatgccgatctgcgacagcgttacatcgccgttttcgctcgtcaggtacggcatctgctgaaattccggcagatcgaccgccagaaccgtctttgcggtacccgctccgtccgcacgcacggtcgttttacccggctcaagtgcctccagacggagcggctctccctgcctgtaatcgctcgaaatcgcaaatgcgccctcgaaatagtagtcgttgtcggtcgaacgcgcggtatcgagataaaattcactgccgcagaagccgctgtcgccgtacatgacctcgaaatcaagctgtccctcctcagcatagcacgaggacagcgtggaccatgtgatgtctggcttgttccggtagctgtcgatcaggtgcgccagcgtgaacggctttacgccgtcctgctttttattctccagatgcagactgatcacacccgtgcccgcgctttcgtcaaacagcacggactccaccgacagacggtaatgctcgttctcgtcggtcaacttggcgttgtccgccgtctgtacatacccttcgagattcgcgtctccgccattcggaaacagcagcggaaaccagctctgtgcattcgcggcaaatgcagttccgccgatgcacagcgcggcagccagtccggcgcagacgattttctttgctgagaaacggcgtaccggcttgctttctcgctcgggcaggctgtccagcgctctgcggacactgcggtcaaattcttcggtcattttcgggaaatcattatggttcatcatgcgaagcacgctcctttcaagtccttgcgcaaatgctctcttgccgctcggagacgggtcttgaccgtgttttccggtatgccgagcattccggcaatctcacgggtcttaaagccctctaggtagtacagctccaccggcaggcgcagcttttcctccagtgcggtgatggcggcatacaggtcgctgtaatcatcagccgcaggcgccggtatcgcctctgcagcagccgcgtcatacggcgcaagccgctgctgacggcgcaatatcgtgctgcactcgttgatgagtatgcggaccagccacgttttgaaataccgcgtgctgcgcagcgaatccagctgctcccaggcccgcaggattgcctgctgcgccgcgtctgcacagtcatgctcactgcggagcatggttttcgcaacccggtacagcgtaggctcggctgccagcaccgcggaggtaaattgctctctatccatcataagcgggttctcctttccgaaagcgtccggacagcgcagacaggtttcgcgaaaagcgcttcctgtctgctgctttcatctattagacggttcggtgcggcaaatggttttgtgaaagggaaattttttgtacttgcattttgcattacctattatacagtacaagcgcacaaaacgaaatcggtacagagattcaaaacacatttccccaccgtatcgcacaatacaaatgaataaatgacgaatgccgaatctccacgttcattttccatcctcaactctccattcctgaatcgatagacaaaagtctcccgccatggtatactgtccttatctggtatagttaaggcaacaccgcacaattaaagctgcggctccttgcgcagactccggtcgcgctgccgcggcgctttgcggaaattttgtgtcctgactttggcttcggttccttgcgcgagttccgtccgcgctgccgagatttcacagtaatacattaagtattactgcaaaaccgcgcctcgttagtacacaaaatttgctcgcaaatcgctcttgttcaattatgcggtattgccttaattcgaatcgaagatcgaattacttatcgataactattatcaaataaaaaatattatttattttcataaaaacctattgacattttggcacaacacggttatactaaagttgttccaaggagagaaaggaaggaacgatttgagaatcacacatgaagcggattatgcaattcgtgtgacctattgtctggcacttgcaggcgaaaagcagtgcgcgaaggatatttccgaggtaaccggcgtaacactccggtttgcacttaaaattctccgcaagctgacgcagtccggtattacaaaatcctacaagggcgttgccggcggctatgagctgaaccactccccatcggagatcagtctcggcgcgatcatcgaatgcattgatggtccgatcgctatcaatcactgccttgcaaatgagttccagtgtacacacatgggcacccagaaggaatgtgattttcatcgcgtgttctcggagatcaaccgatctctgcgcgatcagctttgttcgataacaatggatcgtttcctgccccctcaaaaataaatttgttcaacgatacaggaggaaaaaatcatgaaaaagtttgtttgttccgtatgtggttatgtatatgaaggcgaagcagctccggcagagtgcccgatctgccacgcaccggcagagaaattcaaggagcaggctggcgaaaagacctgggctgctgagcacgttgtaggcgttgcacagggcgctccggaggacatcatggctgacctgcgtgctaactttgagggcgagtgctccgaggttggtatgtatctggcaatggctcgcgttgcacaccgcgagggctatccggaaatcggcctgtactgggagaaggctgcattcgaggaagcagagcacgctgctaagttcgcagagctgctcggcgaggttgtaaccgactccaccgagaagaacctgcagatgcgtgtagacgctgagaacggcgcaaccgccggcaagtttgatctggcaaagcgcgctaaggctctcaacctcgacgcgatccacgacaccgtacatgagatggcacgcgacgaggctcgtcacggcaaggctttcgagggtctgctgaagcgttatttcaacaagtaattgagactatttagagggtgggcagaatgcctgccctcttttttagaaaccgataaacagcagcctgtccgctcttggagcggacaggctgctgttttatctgtgtttttcacttttgcactgcacgggacagccggagcagtgtccggaacagccggacggatgctttttcatcgaacggagcgcagcaaacagcgcaatgccgatcaatgccagaatcaaaatggtgggaagattcatataccgtgcctccttatgccaggccaaatgccagaccgacacagcggacggcaaaggcaatgagccatgcgatcacgcattgggtcagcgcagtcgtgatggcagcccgcgtgctgcccatctcgcgctttacagtggcaattgctgcaacacagggggtatagagcagcacgaataccagaaatacgaccgcggtaaacggcgtaaacagagtgccgatgctggatacctcaccgccaagcagcagggtcagcgtggatacaacgctttcctttgcagtaaagccggtaatcagggcggtggacacacgccagtccgcaaagccgagcggtgcgaacagcggtgcaaaaatgctgcccagcgcagccagcaggctgctttccggcatagacaccacattaaagcgtgcatcgaaggtctgcaggaaccagattacgatagaagcagcaaagatgatggtaaatgccttctggataaagccctttgccttttcccagataaggtgcacaacacttttggcactgggcagacggtaattcggcagctccataacgaacggaaccggttcgcccttgaagcgggagaccttcaaaatgaccgcatacaggatgccgcagagaatgccgaacagatacaggccaatcatggcaagcgcacgataccgcctggggaaaaaggcgctgatcatcatggtgtagatgggcagcttggccgagcagctcataaacggggtaagtaaaatcgtcatgcggcggtcacgctcactggacagtgtgcgggtagccatgatggccggaaccgagcagccgaagccgaccagcatcggcacaaagctgcggccggacagtcccagcttgcggagcggccgatccatgataaaggccacacgcgccatatagccggtgtcctccagaatcgagaggaagaagaacagcgttacaatggtcggcaggaagctgagtacgctgccaacgccgtttgcgataccgtctacaacgagcgagtgaacaacggggttgatctgcagggcggataacccggcatccagccatgaaatgcaggcatcgaccagaacggtcatgccgtcggacagccatgcgccgatccaactgaaggtcatgatgaagatcaaacccatgataccggcaaagcaagggatagcggtgtatttgccggtcaaaaagcggtcgatcgccatactgcgtttatgctctttgctctcgtgcgggcggacgactgttgtgctgcacaggttttccagaaagctgaaccgcatgtttgccagcgccgcttcgcggtccagaccggaatccttctccatgacggatacgatctggtcaaaagcggagcgattgtcatcggacagcgcgagcgccttttcaatgagcgggtccttttcgatcagcttggtggcggcaaatcgcaccggcagaccggctcgtttggcattcggctcgatcatcagagcggttgcatggatgcaccggtgcacagcggctaccggatcgttcttatcactgctgtcctgacagaagtcgatgcctccgggtgtttcctgatagcgggcgatgtggattgcgtggtcgatcagctcatcaatgccttcgttctttgcggctgagatcggcactaccggaatgccgagtgcctgctcaagctcatttacatggacggtgccgccgtttgcacggacctcgtccatcatattcagcgccagcaccatcggaatgcccagctccatcatctgcatggtcaggtagaggtttcgctcaatgttggtcgcgtctacaatattgatgatgccgtccggcttgttgtccagcagaaagctgcgggttacgatctcctcgctggaatacggtgacagcgaatagatgccgggcaggtcggtaacggttgcctccggatggctgcggatcgtgccgtccttgcggtccaccgtaacaccgggaaaattgccgacatgctggttggcaccggtcagctgattgaacagcgtcgttttgccgcagttctgattgccggcaagcgcaaatgtcagttttttatcggcagccgcggctttggcgtgctcataaatgtggtagtccttggatttcctgagctcgcccatgccggggtgcgccgcaggacggtggcgtacctgtccggcggaaggcttttgggttcgctgatacggcgtgccgacttcgatcttccgcgcttcatccaggcgcagggtcaattcatagccgcgcagctcaaactgcaccggatcacccatcggagcgaccttctgcagcgtaacctcggtctgcggcgtcagtcccatatcgagcaggtgatggcgtaaggctccgcttccgcctactgcggtgatcttcgcactttcatgcggtttcagtttatccaatgtcatatctatatctcctcgcggcttcatgccgtagacagttttgctctatactcgtgtactattattctcctatgagcgggagttgtcaatgcttattatacagcaatcctgccgattgtgcacgcgcagcgcacgaatgacattgagaattacaaggaacataacgccgccatcggaaaacaggacatatcgacttcgtttccttgataatatacgggaaaacgaaattgaatactctttaatatctgtccgttttccaacggctcgggataaatctctgcataattcgctcctcctttctcatcaatcatcattctcattctgagctgatgtggtcaactccatcattttttgtgagtatgtagcaccatcaatttcttcatcagcatactctctcatcaactcatcaatctgttccttaagttcatctctggtcattttttcaccccctctgttagaacgccatatcacgttttattactttttgaatgggcgagagaaaatcttaccgccttctgaaacaagctcctccgcatggtcagaaacaaactctgccacgctatgccattctttcttgaagcgaaaaaacaactttccgtcaattagcttcgtcggacaagtatatgttctgcctcctgaagtaatttgacaccaattcaaaattttgttaattcctaatacaagcatttatttttctccattccgtacagtttatataagaaaggctacaatacgttttattcttgtctaacagtattttaacataaagcagtgagtacttccaccacaccaccaagattataggtttaaagaccaacagttttatcaaaaatctattctgctatgcgattatggtatcatcttaaaatgtcgtagcgcttcctcaatcaactttaccttttcaggcgggcattgaggttgatttgggttctcttttttagaattgttgtagcaatctctttcaataataccatgctttttctttacctgagcaatgtaaagcgaagatacttttacacgatgcttatcaaatatgtaatcttttatttcatcataagttgcctttgcttcggatgatgttaaatccagttcgtccatgtcgacggtaatgtcgatatatgtatcgggcttttttctaaccaactggacaaccgtctcgacagttgtttcagtttccaagggaagttctttcacttcctcaccatcaacaggcacaggaaaattgaatacgatcttctttatccagcttccgtctttccttttctccgggaacatctcaattcgctcgataaaggccttcataaactccttctgctccgcttccgttgcggaatggtagacttcatcaaatgccagcaacaagcgatagatattgtctccggaaatcttctcctgctggatgctgcggatctgactttgcaattcgccaatctgaacttcgatttcctctatggtgtcatactgctcatcatagcggcgctgcaagtccaaaatctttctgtcatagtgggcatcattgatgtccaaggtatccatctgacgctccaagcggcttttcgttccaaaggcttgctttagccgcccttgtaggacagcaatctgccgttccatatcttctgtatcaactgctgttccgattttggcctgaatcgcttctacaaaccgtggattgttgaccatagcggagataaccttcgccacaaatttgttgatttccgtctgctcgatattcagacggaaactgcactcatgcccggtaggtgttaccgtatttttgcagtagtaataataccgtgttttcttgtccttgctgtgcgccttggcgatattgccgtacatactctttccgcagcatgggcatttcaagataccggacaggatgtgtgcgtggtctggattgttaaccttttcccgcttaaaagaattgatcttgcgcttttcctgtgccagataccaatcctcttcggaaatgatagcttcgtgttgtccttcataaaccgggaactccgactgctcaaccacgtgcatctcgtttcttgtaccctgtttcttttctgttcttcgtctgccgtaagcaatctttcccatataaacaggattgtacaatacatttttcacaaaatctcttgaaaatcccggaatggtattattctgtcttagtttcttagtataaccattgcggttcagatattttgcaactcctgcaacaccctcattagtgtgaatgtagcggtcataaatgacacgaattacttccacttcatcctctgcaatgacaaggtttccattttccagtttgtatccatatggagcgaaaccgccgttccatttgccctcacgagccttttgctcacgtcctgccattgtctgtgtgcggatattttctcgctcaatctctgccaccgcagacagcacagagatcatcagctttcctgcatccttggagctgtcaatgccatcctccacgcagatcagattgacaccgaaatcctgcatgagttgcaaagaattcagaacgtccgctgcatttctgccaaatcgggacagcttaaagaccaacacataagaaacatcatctttgccgtcctggatgtcattcagcatccgttgaaactcctgccgcccttgaatgttctttccggaaaagccctcgtcagaatactccccggcaacgatcatatcctcgtatgccgcatacttccgcagcttgtcacgctgggcatccaagctgtatccgtcaacctgcatcgaggtggacactcttgtataaagatagcatttaagttgtttctttttcagaatctccacctccctcattccttccttttaccataagtccctcgttgcggatataatactccaaaagccacagcacataatccggtgcatggcggttgtccaattcccattcagtcatagtccggtaaggaatatggacgagcttgcaaaaatctttccgattcagtcctgtgctttcacgcaactttataattctgtttttacaatccatccgtcttttctccacaaaagcaaaaaaatacacgttgcgtaatcattatagcatagccatagcgaatacgcaacgtgtaaattgcaaattttatgcagccttatccgtcagaagctgcgcttgattactttcctcggaatgctccactccctgcggtgcgtcctgttccaatttatccaaaacctgatgtccatatttctggagcatctggctcataacatccacacagcggtcaaatgccgcattatatttcgcttcctcataatatttcttcaataggcgattcctccatcaaagttccatatcctgtccacgcttccgggcagggtgttcgtgttcctgtgtttgctttcctctgatgaggatagaattgataaaagcccgaaccttttcggatgcgatttccagtgcatccagaaagggttgggctttctgtttgagttccatatatttttcgtttaccgcttcataccgctgcttccagatggaaaccgtcttttctgcggaagccagtttttctttcagacgcttgttgtcagcattggcgataatgccattgaccgcatagcgtttgagtgtgtcgcattcatccggtgtcagcgtgatattgtttccgaatgtggcttttttgcccattacttcaatgtcctgcactgtcagcgcaatggtctttgccgccttggtttccttttgcaaagattccagtttctttttctgttttgctgtggcagctttggcatcctccaaattctgttctgcctgtgccacctgcccggtcacagcttccagccgctgctgttctgcctgcaccttgaactgggtcacagtcagatgttcctcggtgcttccacgttctccacgctccacatcggtataaccggcgtttcgcatgaaattgaaaaagtcatcctgcaacacactgtaggatgacttcaaaatctttttcccttttgcgttgagcatgggatttccgtcctcgccaagcaccggcttggactcccatttcttactgcggctgacctgtgtgatgacctccttaacggttccccggagggcttcatccttgcatcgcttcgaccaaaggatctgcttttccaccaccgggatataaaccacatgaaggtggtagtggtacacatcttcgcccaaagcttcggacattgctcggttgcgctcatcggcgtgcatcacagcggagaggatatactgctcaccacctacgatctccgcagcagctttgtaggcatcggcataaaactgtttcgcaaattcatagccgccatgattgtagaaataagcggaattcacatcaaataccaactcaccgtatttgacggcatccggtttcagacctctggtggagatcacgccgtcttgttccatctgctcaaacatttttacataatcgtccgtgggtgctttgaaatggacgttcagagaagtgcgttccggcacgatgtcctgattgctgtagctgtccttttcacgctcattgtgttcctgtaccttcgccacatcagccggtgtttccaagtcctgatttctggctacggtacggtctattccatcatttcttgccattggatttttcctttctttgagatttgcaacagcggaaggctggagaacggcactttttcaaagtgtaataacccactatgacactttcatccatactggctgcaaagtgccgtgggctctccgagggctctcccgagggggaatgcggtcactgcggtgacctctgctgaccaaggcgaaaatgtctgcgccttttcccatggtcagcccgtctgcatgaagctgttctgtgtcaacttcctcttgcagccggtgtccacagacactttttcaaaagcctgtggacatagaaacagcccgaacgagaggatgtgtgctgtttctataacaagcgtttcacgctcttttgctgcgtacatacgtaccagcaatgggatttactcgacctgccgccattcctccggaatgtcctccggtacgtacgtacacggcgaatctccgtaaaacccatttatatgaggtcgtgcaatggcttccactcccatgaatccccaaacccgccgtccagcagagttggtgatgttgttgcaatgctccagattgaattttctggcattggcaatcatggcgtcgctgaagctgcgggctttcagcggtgcaagggagttttcctcgcaccacatccggtagatttcatagaaatccttggagctgatggacgcatccgctttgcgccggatatatccctctgattccatgaaaccaaagatattgttgttgtcacgcttgaccgcttcccgattttcacggatgcggtcactctccgtaaacttaaagttgttggcaacaagccgctgcaagccttcaaatgcccacaggaagataccctcggcttcagctttcatcttctctgcaagatcaggatcgtcagctctgtccacctgcttttccttggtggtcagcacaagctgtctgcgataaaatccgtcgctgcggtcatacaaggcttgcagatcaccgttgctgaatgccagcaatcgggcgaacatccagccctgataactctgcttgcctttacgttccaaatccatcttgccttgtgctgtcacgatggattttacatagttggtctggcgcagagcttccatccgcatatcatcatccacgcacaggagaatgtgttccaaatcggcacgggcgaagcggttttcagaaatcttgccgatgctgccgtctttcatattcgtgccgaagatggtagacagtaccgcaccgatttgagatttaccctcgccgccgttgcctttaatcaccatcatgcgctgccccttgttggagggaatcaggcaatagccgataaactcctgcaaagttggaatgtcctcggcgtaaagcaacccatccagaaagttcagccagatcaccggcgcagtagcatcgggattgtaagcaaccggcaaacggctccgcacgatagccggtctgccctcggtaaatgtgccgttcaatagcagcgtaccgttggacaaatgaatccgatcctgctccggtggaaagtccggcacttgcgcttccagtttcagcacttccagaatgttggtgatcttccgggggatattgtttacggcacagaatttcagcttgtcgtaaatctccccacgcagaggaagatcgtccgtcactcgaccatcgggcgtgaaaaaagctccgtttgcgaagatgatcctgcgctcttgcagaaattcttcacaaaacagagcttcgttgatgttctgcccgtcaaaccacatgggcaagttcatatcaggcgttttccggttcttcgccatggtgcgccaccttctttttcttttgtgcggtatactcttgcagaaaagcaattttgccgtcctgcatcagcttgtccaccaatgccacccgttcttccagatcacccaccgtcagcacatctgccatatattcgatatggcagtgcatctggcaggcttccacaaaacggtcatccagagcatcttccggtgtcttgggagcatagcgcactttccaatcttccaacagatgcaaataatccgtcagcacccggaagcacagcatttcatcctcccggaactgacggatatagggacgcttcggcttgaccatagctgcggcagtgggcggtttcgggtcaagcccgaagtccaaagccagcttttgcgctgcttcataactgctcagattgaacagccttgccacaaggtcgatcacatcccctttggctccgcagccgaagcagaaaaaatagtcctcattcagcttcaagctcggatgcctgtcgttgtggaacgggcagcaagccatgccgttgtggctcactttcagcccgtagtgttcggcggcttgcttgacgctgattgccgccttgatggtttcatagattgtcatagaaaaccctccgttcataatattctggaaagcacgaagcacccgccgtgattggcaggtgcttcgctccttctattatggttatgacggatttttcaaaaaacaggctaatgacaggacaatcctgtttcaaaaaacaggacaacttatctgaggacgtagatttcttcacatttacatgatataattagaaaaatgaaaaaacaggacaggagggcaagcatgaatcaagaattgatgacattggatttctggcaggatacggtcatatatgagagcaaaacatttcctgtcggtacgcttgcctgtgatgcactgaatgttcctgtgaataccattgcaaaaataaacgagcaatgcgagaaaatcaatctgctgcttggaatattaaacgccggacaggatgcttctgcactctgtcctattgcaaaggaagctgctctgacgatgctcgatattctcagtcaaacaccgccgttctcctatatgaatatctcaaagcacagagaacggattgaaaaagtctttactgtggacaatgcgctgaaatatgtggagtttgccataaaagccgcaaccaattctttgcaatttgaagaaatccagaactttaccgatgcgatgatgctccaacgctataccgcagttttcgggcatctggcatactcccttggggaataccaaacggccatgcttgattttgcagaaaaaacagacggcaacgaagcagaccgcaccgcagagggttttgcaaaaatgttcggcagctatttcccgccggagttttccatcacggaaggcaatgcctggatgtctaccctgaacaattccgttcagtatgtatccgtcatccgtcccggcgaaaaagttgcgaagctggtcaagcggatgcactatgtatcctttgtagggatgttccggtctgatctctttgagggcctgtgtgttggtcatgcaccaaagaaatgcaaaatctgcggcaagtggtttctgaccaccaacgcacggcacaccaaatactgtggcggctatgcaccgggggacaagctgcaccgcacctgtcggcagatcggcaacctgaaaggcagagaacaacgggagcttgcggacgatcatccggtgaaacagatttatgagaaacgactgaacaccataaaccgctatgtgaagcgtggtactctggacgctgatcttgcagaggttatgaaaaagctggcaaaagataagatgctccgggcattgagcaatgtagcctatgccaagggagcttatgaaaaagaaatggaccaggcggctttgaaaaaggaagcaagtgcaaaaatatacaaagaaagggacaaacatgaatagaaaagaacttagtcagaatcattggaaatactacttaatgctcgaaaagcgttttgttgaatcaatagagtttgtagaactacatgaggacaattttgatgcattttctaacggatatgccctcttaattcaagccataggggcagagttggatactgtattcaaagagttttgcggtttcaatacaacggatcgaaaaacggttgcagactatgcacagtatattttgaccaacacaccggatataaaaaatcaaaaaatcagtgtacaggaatacgatatcgaaatacaaccgtttatgaattgggatattacccagcccgcacagtcgttgcaatggtggggagcatttacagatgtcaagcacaaccgctatgagcagttgaagcaagcaaagcaggagaatgtactaaatatcttgggagctttgtatttgatagaaatgttgtacttgaagaaaatcactgatgggacagacgaatttgatgtgtttgatgaatcttccaacttgtttagtttgaaaaactggacttctaaggctgtgccgctgagccaagcttttgccgtgctaagtgatatgatggacgacgaaaataatactactaacaaaaagttcgatgcataattactgtcgatattgatagagaaagaaccgaaaggaggtgcgctatgctgagtgatttttcatgggacatgaccggatacataccaaaacacgctgtcaatccgcacggtgacggcatcattccttatgcggcagagcgcatcttccaactggaaccggagcctccagcggtgggcaatctgaacgaatatatcctgtctgccttgcaggaaaagaatttgatatatttctcattcttcctacaccactacgagccgcagcttaacaagcgcatcaaagactttctcggtgtggatggcggcgatctgtatgacacagaccgatttatagatataaagctctcctgccgggagcaaatgctccaaaagctgatggactatgaccttgccaagggtgcagagtatgctacatacattttcccgttcatccgggatgctatgctccgttttcgcatgggcgaagaaaaatggtcggtgtcctctctgaccaattacaaaatggtgcggtcaatggcttggctgtaccacaataccaaggatgcggtcaacgaattttccaagaaatacaactgcgatcttgcccttgcggaagaatatctgaaagttgtccgtggaatccgcaatcagcagccattctatgtgacagacgagaacggcgaggaaacaggcgaggatgtagcccttgacgatagctggaactataccgatatcctctggaacggcatacaggcagaaaaggtgcagcgggcatttgagaaactgaattaccgggaacagaccttgcttgaaaaacggttagcaatttgcatgacctgtgggcgtgtcagctcatggaaagaccgccccacctttgaagaactggcggttatgtttgagggcagtacagccagcggtgcagaacgagcctaccgaaaagcagtggacaagttgacggaattgttggttgccgagggcgcaatccatgcagtccggctaaaacagaaatccaagatcaagcgaaaaaagaaaatcgccgccgcaatctacgaatatcaggcagactgcgacggcgaatggggcgaaatatcattagattttgagaacggcaaggcagaggtcattttgcttgccgattgggatacagtgaaaacaaacaaatttgcaagcagagcaatcgcctatcttctgaactgtgagagcgaaaaattgcccaaggaaataatggtggcctttgaataacgagggagtgagatacatggagcaattactgattgttgaagatgatatcggcttgaatcaaggcttatgcaaagcgctgaaagcagatgctcggcagatcatttcctgccaagacctaaaaacggcgaaggagcagctgctttgcggcggtgtatccctgatcctgttggatatcaatctgccggatggcagtgggcttgagctgctccgggaggtcaaggaaaacatgcccggagttcctgttattctgctgactgccaatgacaccgatctggacatcgtagacggactggagaggggcgctgatgattatattaccaagcccttttctctttcggttttgcgggcaagggtgaatacccaactgcgaaagcaagcgtcaagccataaaaatgcgccgatccatattgatctatttcactttgactttgaggctatgaccttttatgtggaagattcaaaagtggaattgagtaaaacagaacaaaaattactgcgtctgcttgttgaaaaccgaggccgaaccatgacccgtggagaccttgtcgaccgggtctggacagatggcgcagaatatgtggatgaaaatgctttgtctgttacgatcaagcgtctgagggataagcttggcgcacagaaatacattaaaaccgtctatggaatcggttatagctgggtgacaaaagatgaataaaaccggcattgtgatcatactgctgtgttttctggcggcggcagctgttgtgttatgggagcggagaaaggccagaaaaacgatggaagaaatcgaaagaatgctggacgctgccatgaccggctccttttctgaaaccaattttgatgaaagccagctatctgcattggaaacgaagtttgcgcactatctttccgccgcagaagcatcttctcaaaacatagcgcaggaaaaagacaaaatcaaaaccttgattgcggacatctcccaccagacaaaaacgccgattgcaaacctgctgttatacagcgagcttttgatggaggaaactctgcctgcatcggcgaaggcaaatgtggaggcgctgtacaaacaatcggaaaagctgcgatttctgatcgattctctcgtaaagctttccagactggaaaacgggatcatttcactctccccccagccgacagcgctgcagccgctgcttgaaagtgtggtagaacaatatactgccaaggcttctgaaaaaggattgtctttgcaaatgcaggatacagatgcttttgctgtattcgacttcaaatggacagcggaagcgctggctaatatcgtagacaacgccatcaaatatacagagcatggcaccattactatttctgccgtaagctatgaaatgtttgcaaggatcgatatatcggataccggttcaggcatcccggaaagtgagcaagcgaagatatttgctcgcttttaccgctcaaatagtgtgcagaaacaagaaggggtcggcatcggcttataccttgcccgacagatcatatccggcgagggcggttatatcaaggttgcttccgttccgggaaaaggaagtacgttttccatatttctgccgaaataacaacaattctatcaaaactgttagatttcattttccgccggaaagaatgtggaaagattcctatgcgataatctgtatgtatcaaaggatcatttcctttcatacatacagattttttcatggaggtactcatttatggaagttttacaggcaaaaaacctgaaaaagatttatggctccggcaataacgcagttcatgcgttggatggagttgatttaagtgtaaagaagggcgaatttgttgcaattgtcggcacatccggctccggcaaatccacgctgctgcacatgctgggcgggctggatcgccctacaagcggcacggtcatggtggacggacaggatattttctccctaaaggaggaagcgctgaccatcttccgccgcaggaaaatcggctttgtgttccaagcatataatcttgttccggtgctgaatgtgtatgaaaatattgttctacccattgagctggacggtggcaaggtcaataaggatttcgtacagcagattgtacagacccttgggctagatgaccgtctggatgcgctgcccaatcagctctcaggcggtcaacagcagcgagtagccattgcccgtgcgctggcggcagcacccgctatcattctggcagatgaacccaccggcaatctggattccaaaaccagccaggatgtattgagccttttgaaagtcaccagtcaaaagttcgcccagacaatcgtaatgatcactcacaacgaagaaattgcgcagatggcagaccgcattatccgtatcgaagatggtcggatcgtctcccagaactaacgggaggtggctacgatgaatgtcaaaaacagaaaatgtattcgaaagctcagcttaaaatctctttatgcgaaccgtcgccgcaatctgatcgccatttttgccattgcgctaacaacgctgctatttacgtccatgttcaccattgtcttgtcgttgaacgccagctatgaaacctaccagtttcggcaggtaggcggctatgcacacggcacctttaaggatgtttcccccgagcaggcggaacgtatcgccgcccacccgaaggtaaagtctgcgggggcacggaaggtgatcggcatcactgcggatggtgtcttttccaaaacgccggcagagatcagctacatggatgccaactgcaccaaatggagctatgccacccctactaccggacggatgcccgaaagcggcaaagaggtgaccatggatacggcagcgttgcagctgcttggcgtgacgccggaactgggcgcagaggtcacggtttcctattccatcacggacaaggatcaaaccgcctttactgtaacagatacctttacgctggtgggctattgggactatgatgaactaatgcctgttcattacatcaacatcagccgtgattacgcagatgatatcgaagcgcaggcagtgaaaacaggtttacagcccttccgcactgacctgaatgtcatgatggcttccagtacaaacattcaagggcagatggagcaggtggataccgatctcggctacacatgggacagctataccgatcccaacagcgtccggatcggcgtcaactggggatatacctcatcccagctggagtcgcatctcgatccggaacttgtgatcgccatagcagcttttttgctgctggtgattttcaccgggtatcttatcatctataacattttccagatctctgttgcgggggatatccggttttacgggcttctgaaaaccattggcacaacgccccggcagctcaaacgcatcattcgccagcaggcacttctgctttgtctgattggcattccggcggggctgctgttgggctatggcattggcgctgttctggtgcctgttgtcttgcgctccacccagttggatgcgggcatcaccaccatcagcacttcgcctgtgatctttgttggctccgtgctgtttgccctgctgacggtgcttttgtcctgctccaagcccgggaaaatggcagccagggtttctccggtggaggctaccaaatatacagatgcgatgcagaccaagaaaaaacagcgcagcacccggggagcgaagctccatcagatggcctttgccaatctgggacgaaacaaaaaaaagacggtgctggtggtggtgtctctggcactgtcggtgacgctgttcaatgcactgtgtgcctttgtgggcggcttcagcatggagaagtatgtatccttcatgacctgcgccgattttatcgtcagcacgcccgactatttccgttacaacccggcggatgaattcatcacgccggaacagatcgaagagatcgcagcaaacacaaagtccagtctttccggcacgggatatgctgtgcgaaaacccgtatatctttggatgacggaggatgctctgcggcaggactatgcaaggtacgaaagtgctgagcagttggacagccatatgagccgcatggagcaccggggcgatatggtgatgggagataccagaatcgaggctctggataacagcctgtttgacaagctgcaagtgttcgacggagatatttctcctatgctggagccaaacaataacgctattgccattgcggtttccttagatgactacggtaatctgcccaatcctgaatactaccccaaggtgggagacacgatcaccgccacctatgcggacgatgtgaaatatatcgacagccgcaccggggaactccgcaccgaagatacaccggaggagtactttcaggaaaaactgtatggagctagagatgtagagtacacggtctgcgccttggtagagcttccgtattccatgagttatcgttatggtggtattggatatgagacagttttgtctgtggataccgcacagagggacagcggcggtgcggccattccgatgctctacctgttcgacacagcagacgacgcagacgaggccgaagcagagcaatatctatcgaagctcactgccggtgagttttcacccttgatgtatgaaagcaaggccacggctcgctctgagtttgctcagttccggcagatgttccttctggtaggtggtatcctctgtgctatcatcgggctggtgggactcttaaatttcttcaacgccatgatgaccagtattctttcccgccgccgtgaatttgctgtgcttcaggctgtaggaatgacgaaccggcagctcaaaaccatgctgatctacgagggattgttttacgcaatgtcctccgtatcggcggcctttattctgtcgctggcggtgggacctcttgcaggaaaaatgctgggcagtatgttctggttctttgagtatcgattcaccattctgcctgtcctgctgacaattccggtatttcttctgctggggtggctgattccttgcatgatgtatgacaatgcagcgaaatgcagtgttgtagagcaattaagggatgctcaataactgttaagcaaaaaacggccctctgccaaggaaaaggcagagggctgagttttaatctaagggtttacattcagttacagtttttagataaatttcgggatcaccgttcaagatcaagtctgcatatccaaccggatcattgtagattagataatccagttctgaccgttgatacatattgtcagcaacctcattctccacggcgatggtatcaatggcaatcatgctgccatctaaaaatttcagttccacacaagcggtatccatgttaaactcacaagaaatcaatctatccataagaaacctccattttgcgggatgttagatcatcccaaaatatttgaatgcttctcggattgctttctctttttcctgcggacactggggctgtctggaatcctcggacttcggcagattatagttcttaccaaccccaatcccacattttcgtttaatctgtgagatatagaggttggacacctttaacccggtatgctccaacacatactccttgatctgcggataggttgccccatcctgaaattcggacatatccatatcttccaaagagaactcaacccgaatctttttcgagtcgacctcacccttggaaagcaagacaaccgtctccacatgaaaagttctcgggaacagatcgaacgcctgtgccttctcgagcgtatagcctgcgccgcacagctctgccacatcgcgcgcaagcgttgccgggtcgcacgaaacgtacacgaccttaggcggctgcattttaagaatcgcgtcgcgtgcagtcgcatccagacccttacgcggcggatcgaccaccagtacatcaataccgcgcttggccagccgctgcgctgcctgacccgcatccgcacagaagaactctgtgttttccatgccgttgcggagcgcgttacgcttggcgttttcgatggcctccggcacgatttccacgccaatggcagtctttgcgtgctcggccagcgccagcgtgatcgtacccgcaccgcagtagaggtcaagcacggtctcctcgccggtcagaccggcgtagtccaccgcacacgcatacagacgctcggcctgcgcgtgattgacctgataaaacgcctcgggcgagagcaaaaacgtgtgcccgcacaggcggtcctccagcatcggctcaccccagagaacatccgtccggttacccagaatcacgttatcgtcgcgctggttgtggttgagcagaatacccgtcagcgacggcgctgccgcgcgcagacgctcgactagcacatccagtttgggcattttcttggttgcggaaatgagcgtcagctgactttcgccgcttttttcgcccacgcgaacgtaaatatgccgaatcgtaccgcgttttttctcataatcgtacggcatgaccgaaaattccgtcatccattcacgcaccacggcggcaatcttgtccgccgtttccgactgaatgaggcatttctccaccggcacaatgtcgtggctgcgcggacggtaaaagccggtaacgatgctgccttctttgtcccgtccgaccggatactgcgccttattgcggtaatgctcagtcgtcggcgcacccgtaataccgagcagctttgcgccgtcctgaccgccaatgcgcgtcagcgcatcacgcacctttttctccttcgcacggagttcttccccgtaggtgatgtgctgataacagcagccgccgcacttatccgccaccggacacgcaggcgcagtacgctgtgccgacggcacaataatcttctctaccctgccgaacgccacatttttcgtcaccttgacaatgcggacatcgcactgatcgccaactgccgtacgcggcacaaataccgcccggccttcgatcttcgcaaaccccgtgccgtccgctgtgtaatccgtaatctgacaacgataaaccttgttcttctgtaaatccatttcttaccccttgatatgagagtgaagagtggagattgcagagcgaagagataaggtgctctccactctcaactcttcactctccactctataattactaatttctaattactcattactaattttataatggtattatagcacgattcccggagatactgcaatcgaaaggagcgtgcaattatggcacaggacagaaaaaaacaggtctccggtgagattccctttcattttatgcaggaaatgggacacagtccgcgggcaatggagcaattcttcgatctgtcgtatcaggcgcggcaggtgctgaccgatgcggtatgtatctcggacgagcctgaggaacgccgcgaaactgccctcaagtcgcttgcaaacggcggcgaaggctactgcgaacggttctgaccgcttttcccgctcgaacggctgtactttgcggtgcagccgttttgctgtattcgccaaaatacgctgtcttgacatcttttatttctaatcgcttttcattgcgttagtgcatatttggtggtagaatagatactgaattattgtgtaaacaactacttatatataatgtaatggagaatatttatgtggatcgcagatcattggaaggactacgccgtgctcgactgcggcggcggtgaaaaaattgaacgatggggcaatcagattctgcagcgccccgacccgcaggctatctggccgcgcgacaaggactgtaaggtttggaacaagccaaacgctatctatcatcgctcaaacgcaggcggcggcaagtgggaaatccgcaagctgcccgagcagtgggccatccactacggcgatttgacgttccagctcaagccgatgagcttcaagcataccggtctgttccccgagcaggctgccaattgggatttcatcgacaagatgattcgtcacgcaggccgcccgatcaacgtgctcaacctgttcgcctacaccggcggtgcaacgctcgcggcggcaaatgccggcgcgtccgtctgccatgttgacgcatccaagggcatggtgcagtgggccaaggagaacgccgcgtcctccggcctgagtgaccgcccgatccgctggatcgtggacgactgcaaaaagttcgtgcagcgcgagatccgccgcggacgcaagtacgacgcgattattatggacccgccgagctacggccgcggtccgtccggcgagacgtggaagatcgaggaggacgttgccgacttcatagacctgaccatgggcgtgctgagcgacaaaccgctgtttgtgctcatttccagctattccaccggccttgcgccgtctgtgatgagctatctgctcggcatcaccgcaggcaaacgcgccgccggcaagattgaggcgcaggagcttggcctgccggtcgaatcgaccggtctggtgctgccgtgcggctcgtcggcgcggtttatcgccgaggaataagcaaaattgaaaatggagaattgagaatggaaaatgtaatcctgacgcaaagtttctccttcgcagtacgaattgttaaattatgtacatcccttgcaaatgataagaaagaatttgttctttcccgtcagctaatgaagtgcggtaccagtatcggagccaatgttcgtgaagcacagcaggcgcaaagcaaaaaggactttctttccaaaatcagcattgcactgaaagaagcagacgaaacgctgtactggctggatttactgaatgctactgattttctaacaaaagaacagtatgtttctttttatcgcgaagcggcatctctcaaacgtctgctggtggctattgttaaaaccacccggacaaatctgaccgaataattatccattctccattttcaattctcaattcgtcaccaactttaccttaacgaaaggtacgaaaccatgagtgaaatcatcaaaaccgaaaacctgcagtacgcctatcccaccgaggacggacagctttccgtgccggtgctcaaaggcgtaaacctgtccatcaagcgcggcgagttcgtcgcggtgctcggtcacaacggctcgggcaagagtacgcttgccggctgcttcaacgcgatccgtctgccgaccggcggcgtatgctacgttgacatgatggacacccgcgacgaaaacaacacctacgaggtccgcaagactgtttcgatggtgttccagaacccggacaaccagcttgtcgctaccgttgttgaagaagatgttgcatttgcgctggagaacatgggcgtgccgcccgcagagatccgcaagcgcgttgacgatgctctgcgtgccgtcggcatgtacgaataccgtgcacaggcgccgcaccgtctgtccggcggacagaagcagcgaatcgcaatcgcaggcgttatcgccatgatgccgcgctgcgttgtactcgatgagccgaccgccatgctcgacccgcagggccgccgtgaggtcatgaatgttgtccgtgagctgaaccgtaaattcggcatcaccgttatccttatcacccaccacatggacgaggccgtacaggcgcagcgtgtggttgtcatgcacaagggcaacgtgctgatggacggcgctccgcgcgagatcttcacgcaggtggacaagctgcgcgcggcttccctgaccgtaccgcagaccatcgaagtcctgtacgacctcgatcagcaggacggtgaaaagctgccgatcgacgcactttcgatcgaggaatgtgcagatattctcgaacaagaatatttgaattgattatccgaaggagaatcttatgtcaaccatacttgaaacgaggggcttgacgcacgtttacggcgcaggcaccccctttgagcgtgttgcgcttgaccatgttgacctgaaaatcgaaaaaggcgaaattctcggtgtgatcggtcacaccggttcgggcaagtctacgctcattcagcacctgaacggtctgctgcagccgtccgagggcgaggtcctgctcgacggcaagtccatctgggatgccaagggcaagtgcagccgcgaaacgcgcttccgcgtcggcctggtattccagtatccggaataccagctgttcgaggagaccatcgcgaaggacattgcctacggcccgaccaacatgaaactgccgcaggccgagattgacgagcgcgtgcgcgaatccatggcggcagtcagccttgcacctgagcttgccgaccagtctccgtttgcgctgtccggcggtcagaagcgccgcgtagccatcgcaggcgttatcgccatgcggccggacgtactcgtgctcgatgagccgaccgcgggcctcgatccggcgggccgtgacgagatttttgagctggtccgcagctaccacaagcagtccggcgcgaccatcctcatcgtgtcccactcgatggaggatatcgcacaggttgccgaccgtctgcttgtgatgaatcacgccaaggtgctgttctgcgacacgccgcgcgaggttttctcgcacgcggacgagatcattgccgccggactggacatcccgatgatcaccaaggtcatgcttgagctgaaaaagcgcggccacgatgttgatacctcggtctacaccgtagcgcaggcaatggatgccctgcgtgcctgcaagcggaaggaggctgctcacgaatgctgaaggatattaccctcggtcagttttttccgggcaacagtgcggtgcaccgtcttgacccgcgcgtaaagatcgtgctgacggtggcattcatcgtgcttctgttcctcgcgcaaggcccggtttcctatgcgctgatcatcgcatttcttgccgttgtcatcggtatttcgcgtatttcgcctaaaatggtgctgcgcggcctcaagccgatcctattcatcgtcattttcacggcggtgctcaatctgttctatacaccgggcacctacattttccagtggcactttctgcacatcagtatggaaggcattaagctggccatcttcatggtgctgcgcctgatgctgctcatcatcgcaacttccatgctcacctacaccacctcaccgattcagctgaccgacggactcgagcgtctgctttctccgctcaaaaagctgcacgcgccggtgcatgagctgtccatgatgatgtcgatcgcactgcgctttatcccgaccctcatcgaagaaaccgagaagatcatctcggcacagaaggcacgcggcgcggatttcgactccggcaacctgattcagcgtgccaaggccatgatcccgattctcgtgccgctgttcatctcggcgttccgccgcgcggacgaactcgcgaccgccatggagtgccgactgtaccgcggcgatgtcggccgcacccgcatgcgccagctcaagatcgcccgcgtagatgtttgcgcgctgctgtgggttgctgttttgttcgcagttgttattatactcaagcattttggcctttgataattgaaaattgataatggagaatggagaattgcggtatcgcacaaagtgcgatttattataatcggcgcttttgcgccgaaccttcattttccattttcccattctcaattctccattcacgacccactaaaagtaactgaaatgatgaaaaatattgcagtagtgttgtcttacgacggcacaaattacaacggctggcagattcagaaaaacggtccttccatccaagagagcatggaggacgcgatttttcatctgctgaaacaaaaagttcatgtttccggtgtcggacgcacggattccggcgttcatgcccgccggtatgtggcaaacttccacgcagactgcacgatcccgatggaccgtctgccgtatgcgctcaacagctttctgcccgaggacattgcggtttccggtgcagtcgaggttcccgaggacttcgatgcgcgcttcaactgcaccaaaaaggaatacgcctattatctgttcccttcccccctgcgggacccattccacgcgcggtacgcatatcggtacaattatccgctggatattacaaaaatgcaggaaggcgcacggtattttgtcggcaagcaggactttgcatccgtgagaagtcagggcacaccggtcaagagcacggttcgtaccattttctggtgcgaggtggagccggtggatgacctcatccgcatccgcgtctgtggcgacggcttcctgtacaacatggtccgcgcgattgcgggcacgctgacgtatgtcggcggcggcaagctgacgcccgagcaggtgcgcgacgtactgctcgcctgcgaccgagagcaggccggaccgaccctgcctgcctgcggtctatttatgaaccgcctgtggtacgacgatacacccgaactggacagattccgcctgtcggactgacagatttcaagttttattcacattttcacccattaaacacgctacaataaggaggcgggatttcatgagcgaacagaatccaaagcagaatatcatccgctttccgctctccaggcgggagcgccgtcagcgcctgctcgacagcaaggacgcgcgtatccgcacgaccgctctgctccgcatgctctgcggctgggctctggtgctgggaacagccctgttcctgatcgccaactaccgtatttttacgccgacctcgctgcgcacgctcggcagctatattgcggccggtattcgctcgcatgacggcgatatcaccaccatcaactacgaaaacgagaccttcagcgacggcgcgctgtttgaatccggtctggcgtacgcggacagtgacgcgctgttcctgtcccgtgcgggcagcatgaccacgctgcgctattcgctcggctactccgatcccgcggtagaaagcagcacgaattatgtgctcgtgtacgaccgcggcggtgtcaaagccgcactggtcggctcggcaggcgctgtcgcggagctgaagctggaatccaccatcctgaacggttcaatcggtcgaagcggccgtttcgtgctcaccaccaacgagcacggctaccgtaccgccgctgccgtttacgacaccgcaggaaaagaggttttcaaataccgcgcttcggaatactatattgtatccgctgtgctctcgccggactgcaatacgctcggcattctcgccttccggcagaacggcgtaacgctcgagtcccatgtgctgttctttgatgtgtcctccggcaagcagatttcggacaccgcgctgactgacgcgctcggtgtaacgctcacttattccgagaacaacgccgcaatcgcgctgtgcgacaccggcctgtatcatgtcacccgcagaggcacggtcgatgtgctgctcgaactcagctcgcaggatctgatcgctactgcgtctcagggcagtacgatggctgtcgctgtgcgctcctacctgaacgatgcacgcagcgatctctataccgtccgcaacggcagcctgcacggcccgttcgcactgaccgaggagccgacggcgcttgctgtctccaacgccggtacggcggtactgtccgcgtccggtgttacggtctacaacacctctgccgagccgcagtggcacaatgttgacgctgtcggcgcacgccgtgtgctcatgaccgatgacggtacggttttcctgctctacaaccgcaacgcgcgtatctttaccgcgcattccgaacgatccgaggaaatacatgcagataactgatatcaacgattttatttccacagcggcgcagctgctcaacgcgcctgaccttatcctcattgccgtgctgctggccaacgtctggctcggtgcccgtcggggactggtcggtgcgctgtacggcgtgatcggccgcatcggtatgatcgccgcgtctgttgccgccgccaagtacaccgcgccgtatatcgcgcagtgggtggtcgtgccggcagtcggtcagctgtttgaaaaacaggccgcgctcaagaccgccgaaggcgtgctggatggtctgcggcagaccgttaccgaagcggctgtcggcatgtcggagagcatcgcgttctccatgctggtagtgctgttcagcgtgctgttcggacggctcatctggattttcggccgcagtctcaagctcattgttcggcgtactccgctcagcgcactcgattccgcaggcggcgcactcatcggctttgtaaccggcgtcgcattcgtctgcatcctgctgatcgtgctgcagtggctgttcccgatcacctatacgtcgctcggctatctctcgccggagcgcgtcaagcatacgctgctgctcaaacagcttgtggacgttttacctatcgccatttaatggagaacaccttaattctccattttcaattttccattttccattccctaaaggagtttaacctatgaatatgccaatgtgctcgcggtgcaagaaaaacatcgcggtggtgttcatcaccaaaatcgagggaccggataagaccacccaggagggtctgtgcctcaagtgcgcacgcgaactgggtgtcaagccgctcgacaacatcatggagcaaatgggtatcaccgaggacgacctcgaagcgctctccggtgagattggctccctgtccgacctgaacgatctggttcccgccggttcggacggcacggacgacgacgccccccacgagaccgacccggtcgctgccggcactctgccggggcagcccgcaggcggctctcaggaggagacctgcacccgttcttcccgcaaggaggacaaaaagcgcaaatatctgaacaattactgtgagaacctgacccaaaaggccgcagaaggccgcattgaccacatcgtgggccgcgaccgcgagaccgaccgcgtcattcagattctgaaccgccgccagaagaacaacccgtgcctgatcggcgaacccggtgtcggcaagacggccgttgccgaaggtctggcagtccgcatcaacgaaggccgcattccgttcaagatgcgcaacaaggaggtccatctgctcgacctgaccgctctcgtggcgggcacgcagttccgcggccagtttgagagccgcatgaaaggcctgatcgacgaagtaaagcgtatcggcaacatcatccttgtcatcgacgaggtgcacaacattgtcggcaccggcgattccgaaggctcgatgaatgccgcaaacattctcaagcctgcccttgcccgcggagacattcaggtgatcggcgcgaccacgctcaaggagtaccgcaagtatatcgagaaggacgccgcgctcgagcgccgtttccagccggtctatatcggtgagccgtcggttgccgagaccaccgagattttgaagggcatccgctcgtactatgagaccttccacggcgttactgtttccgatgagatgtgccgccgtgccgctgagatgagcgaacgctatatcaccgaccgttttctgccggataaggccatcgacctgatcgacgaagcctgctcgcggctcaatctggattctccgcagctgtccgagattcccgagctgcagaacgagcttgagcgcctgcaggcacagcttgacgagctgacccagtcctctgcccgcgccgaggaggaggagacctacgccaagatcgccacctgccgcagccgcattctgcaggtggaggcacagctgcacgagctgctgaccaagcctgcaccgcaggttgacgaacagcttctggctgaggtgatcgaaatctggaccggcattccggcatccaaggtagcggcacaggagtctgcacgcctgcgcgatatggaatcccgcctgaaatcgcacgttatcggtcaggacgaagccgtagacgcggtctgcgcgtccatccgccgcaaccgcgcgggcatcagccccaagcgcaagccggcatccttcctgttcgtcggaccgaccggcgtcggcaagaccgagctggtcaagcagcttgctctcgacctgttcgactcgccggatgcactcgtgcgtctcgacatgtccgaatatatggaaaagcacacagtttcccgcctgatcggttcccctccgggatacgtcggctacgatgaagccggtcagctgaccgagaagatccgccgccgtccgtactctgtcgttctgttcgacgagatcgagaaggcgcatccggatgtactcaattctctgctgcagattctggatgacggccgtctgaccgacgcgcagggccgcgttgtcagcttcgagaacacggttatcgttatgacctcgaacgccggttcgcagtccaataacacgcctgcaggcttcggccgcaccgtgtctcagatgagcaaggaccgcgtgatgaaggctcttgaagaaatcatgcgtccggagtttctcaaccgcattgacgagattatcgcgttcaaccagctgtccgaggataacttccgccatatcgctgagatcatgctcggtgagctgcgcaccacgctcgcggataaggatatccgcctgacgtgggatgacagcctgctcggcctgctcaccgagaaatcgtactcggtcaagtacggcgcccgcaatctgcgccgcctgatcgaaaaggagattgaaaatccgctggccaccgccatcgtcaccggtgataagccgctgatgggcgctcacctgtccgctgtggacggcaaggttaagctggataccatctaataattgaaaattgagacacccaccgcagtgggcgtccagcgagcaaccgcccgcaaggcggctcttagcgagtcgaaatggagaatggaaaatgcaccacattttttcattctccattttctttgcctctcggttaccgttcttcggttgcattgattgacaatctctgtcgaatacgatataatcgtgtaaattactggaggtgttatttatggatttcagcgattcctcgactttctccaccgcatccggcaaggactatcattacgttgtcctgcaggttactttgaaggaaaaatttctcggcaccggttccggcaacctgaccgaactggaagaagcgattaaccatcaagcgcaaaagggttatcgcctgcacacgattactacatcgaacggcggcagcaagggtctgatgggcggcgaccgcattcaggcaaccatggtattcgaaaaggttatttaacaaagcaaaaaccgctctttcgagcggttttttgttatttatcggcaaatcggaaccagaacttcggtccaatttcggtattctccgctccgcaggcatagccatgcagatcaaacacggtcttcgcgatcgacagtcccagtccgtcgccttttgcgctgcgcgacggatcggcctgataatacgcctcccacagccgcggcagcgcgtccgccggaatggcgtctccggtgttcgtcaccgagagcacgccgtccgcgaggtgcaccgtgatgcagccgccctcgggtgtgtgctgcacggcgttctcgagcagagcgtccagtgcccgcgtgagcagtaccctgtccgcattgacctcgtattcgccctgtgctgcaaattcggtgtggatggtggaatcggtcggcagagccgcctgcaggcgctcctgcgccaattctgccagagagaacgccgttcgccgcagagtctttgcgccggtctccagtctcgacagttcaagcatctgccgcacactgccgtccatccgatgtgcctgctgctggatgacacccagatagtgtgcctgcttttccggtgcaaggttgtcgccaagcagctcggcggtggcgctgagcacggagagcggcgttttcagctcgtgcgcaagcgcggctgtcgtttcacggcgtacccgctctacgcgctcctgtttgcgccagacgcgcagctgcgcaccggacagcactgccgcgcagaatagcgccagcaccagactgaacgcccatacgggaatcagtaccggcagcaaggctttgagcggatatccttccgccgcataggacaccagcacagcgccgctttccgcaaacggacaatatctgatcgtccgccggtacgttcgcacgagccacagcttctcgaccgtttggctgctgtttgtgcggctcgggtattctgcccattcccgcagcgcctgccgcgcgggcgaggacagggattccgcaatctgttcggtcgtggcgccgttcggtccggggcacaccaagcgattacaactcatggttttcagcgtcagacctttcacctgctccgcgtcatatgcgcattcaatcgtgcgcacctctccggtcggctcccaagtgccgctcttggtcggctcgatcgtgatggatttcagataggcgtcatcgcggtatccgggcacgctgtccgcccacgcctcaaaggtcatcttcggcagcgattctattttcgactcgcctgtgcccgcacccgcaagaaccgcctcgcacacctcgcgcggctgaccgctcatatccacgcggtacaggttgtctccctcgatcaactcaagccaccagcggttgctttgcagaactttgccggatttcaggtcggtgatagcggtctcgatgatctgcagattgggcgggtctgcgctgtccgccatgaataccggcttgctcaatcgtctgcgcagttccgtctcgtccgtcgtgtcatagctcgagggatcaagcaaaaaatcggtatcctctcccatcagcttgtccgatttgctttccatttccgccagcatgagctttgcacgctgctgcgacagcaggacggtgaacaccgccatcactgccagccagaatgcaaggaagcccgcgccgattcgtgtgaaaaagctccaaaaggttctacgtttggttttcatctccgtccacctccagcttatagccgcgcttcaccacggttttaatgcagtccgcgtgcggaccgagtgcgcggcgcagctttttgatgtgcccgtcgatcacgcggtccgtgccgtcaaaatcccagccccacgcaagattaagcagctcgtcccgcgtcagcacgcggtttttgcgctccatcagcgcccgcagcaaagcaaattccttgggcggcaggtcaatgcgcctgccgtccgctgtgacaatcccccgttccgggtcaagtgacagggtacccgctgtcaatgtattcccgacgccaaggccccgcgcccgccgcagaagcgccagcgccttggcgtacagcaccgccagcgagaacggcttgaccacataatcgtccgcaccgaggccgtagccgtgcagcttgtcctgctcgtcctcgcgcgccgtgacgaacagaatgggcgcgtctccctgctctcgtgccgcgcgacacagcgcgaagccgtccgtacccggcagcatgatgtcgagcagcagcaggtcgaatcgccggatctcgattaagtgcagcgccgtgtcgccgtccggcgcagccacgaccgtaaaatcgccgccgcttttcgcggtgaagtagtcgatcagcacctcgcgcatggcctgctcatcctcggccagtaagatcgttgctttcatgctctctccctcctttgattacagtatagcatgaccgtctgcccttttgatgttctttgcaaatttggccgaaaaaagtttttcaaaaaaatttgaaaaaagatgttgacattatggggttttattgatatactaaatgagcgtcagaaagacccgcgggtgtagttcaatggtagaatgtcagccttccaagctgaacacgtgggttcgattcccatcacccgctccattttcttcgaatgggtttgtcggaattgatatgcgccagtagctcagccggatagagcaactgccttctaagcagtaggccgggggttcgaatccctcctggcgtgccatttccgtcggctgcaaactttatatggtgggtatagctcagttggttagagcatcggattgtggttccgagggtcgagggttcgagtccctttacccaccccatataaccctgtgacgcgctgcgaacgcagcgcgttatctttagggtaacgctgtttcgagcaaacgaatacgggggcgtcgccaagcggtaaggcatcggcctttgacgccgacattcgctggttcgaatccagccgtccctgccattacggcatacgacttaatttcatactcagcgcaaaacttttttgacctgacccagtagctcagtcggcagagcacctgccttttaagcagggtgtccggggttcgaatccccgctgggtcaccaaaatggaagtttagctcagctgggagagcatctgccttacaagcagagggtcacaggttcgagccctgtaacttccaccatcaagcacttacgaaagtaagtgctttttctttttagcgtctgcctatcagagaactaagactataaaggaacggcagaggatttttactaccgtaggggcggaccaatgtgtccgcccatttctttacctctacgcaatgccagactccttgctgctacacatgaggtttcctctctgcaggcgcgacacaaggtgaattgcccgaagggcaagagagagtcccctgaggggataacagtgtcgcgcaactcgtttgcgcgttgctgcgcacagcacctgcggatttcgctctgcttacatttcacctatccgattttctatgcagccgttccaacaactcctgttcagtgtcgttttccggttcagaattaccattttcctgcatggccatacgtgctcgacggtacagattcagcgaaatcaattcttccatctgcttctgcaccgatttctcaaaattctgcacatcttccagtaattcaaaatataatgtttcgtagtccattttgcacctcgcattatatgtatataacaacattagcacgcaaatactccataatcaaggaaaagttatatctatggagtattaactatgaaacgcaccacacctctcacccgccatattggcggcaaggttcgagaatatcgattaaaaaacggttggacgcagacagaattagccgcacgcatgcaggttgtcggctgcgaccttagccgtgaaattattgcccgcattgaaagcggctttcggcagacctcggtctttgaaatcgacaaattcgtagaagttttcggtatcacctacaacgacctattcacacaataacataagcaaaatgcagaggcaggaaaagcaatttctcctgcctctgctgtgcccggtaaaacgatacttgctatatcatctgtggttcgcggtttaccgaaacgaataatttacttttcaagctcggtccagtcacgagcgtcgcggatggtggtccacttctcgtacttatcgtccttgctcttatccgagtatgcgtggctgttggtagcctcctgcacagcgagatagtaccatgcggaagcatcggaattatccggccacttgatcatgctgtcgagcagatcgctgctgttctcgggcagacggttgagtacgcggttgacaagcgtcatcgcctctgcgcgggtgatatactggttcggacggaacgtaccatccggatagccattgatccagcccttgtttgcggcgataccgatctcattctttgcccagtgagatgcgatatccgtgaacttcgaggacgtatccgtgttcttatcgtcgaagcgagcggcgattgcggcaaattccgcacgggtgatcggcgcattcggcgcgaacgtgccatcgttatgaccctttacaatgcccatcgaagacagcgtggagacagcatggttaaaccactgaccgcgcgtcacatcggacaggctgttggactgggtagaatttgcggtgcggacttcctcggtcagcagacggaagaagatggttgccacttctgcgcgggtgatgttgccattcggctcgacgttgccgttcgggtagccgacaatgtacgcaaagtggtcgtcaccgttcagaccggtcggtacatcatccggaatgtcaacggtcggtttgctgctgccgccgccaccgccggacgatctgcgggtccatacgccgatcagcttgacatcctgctgaatgtccttgatctcggttacaacatcgccaacgccgttgatccgccagccgctgaacgtgtagcggctctgcgaggtggtctgtaccggtgctacggtgtagctgccgcccttcttaaccttggctgctgccggaactgcgcctgcatcagacggaatgtcgccggttacttcgtaggttacgctgcagagctgaccgtgtgcagccttgagcgccagtgcatcggaaacagcctctttaccaaccgtatattcgtcagcgtaataggcatcgccttcaccatcgcccttccagcgcttttccttgccgtcgtgataccagcctacgatcgggtgctcttctttgcagtcatccagaatccagccgtcaccgacaggtgcaaaggtgagcgaaggattgtaggtaaccttatttttatcaaagctgttactataaatatcgtcacctgcaatatctgcatggttattgtagatttcagccttgccgctaatcttagcagtgccgccgcgattgtacaggccaccgccgtagctattgctatggttgagtgtcaccgtgccatcctgcatatccagaataccttctggaaggatttcaatgccatttgcattaccggaagcagtgaactttgcaccttcctcaatctttacattgccataccagtaacctccactggtatagacaagcagacccgccttaccattgttattcagcataacggttgaaccagtagcaaacttgctctggtcaccaagtttgtcaccaatctctatgccataagcggtattaccacaagcactgagcgaagaagtagaatcaacagatacacctctaataaatgcaccccaactacgtccaacattgttgtcagtaatcagcgaagaatagtcagaaatttcaactgagccgtaataacatccaaagccgcctctgccgccgtttttaccgcagtcagaaatatcaatcgtagaatgaccatcaatttttatatccgtgggattaactgtcatgccattccatttgcagtcggtaatcttaatagcagaagaattgctgacctcaatcgtgttgtgaattggctcctctttttcatcatgctcggacgcatctatataaataccactcacatccgcttgattaaaaccggagataataatttgcgagttattggttacatacatgtcactcgactgatacaagaacatgccgtgacgtttgctaccctcacctactccattcaaaacaagcgtagaattatcaaacgtcagaataccatcatcaaaaagattagtcgtattgccactatgaatcggattgtccgaaacgccttcttcaacaaccttaatattctggaatgtcacattggtctcgttaaagtacatgcccagaccattcagggtaatcgtcggttcagtgccttccgcactcttaatcgtcaaattaccttttccgttgatagtcagaccgtcagcaccaacggtaatatccttaccgacttcaatcgtatcgccgtcgtcagcctcagcaatcgcttcctcgaggctgccatactccttcttaccgtcaatcttagccgtgaactctgccgccggaggtgtaaccggcgcattatcgttgcccgagccgcctacttcgccctcctgctgattagctgcggctgtatcgtcactgccgccgttgctgtcgtcagcggattcctgtacattctcggtatcaccgctgctgtcgtcagcggatttctgtgcattctcgttgccgccgtttgcctcaacatttacatcgttattctcagcctgctgaacgtttttaccgtcgcttaccacgtttacaatattattattcggggtgtcggatgcagcatcgtcgtccgcgcctccctgcgccgcaagcgcggtaacaggcagcatggtcagcatcatcaatccggcgagggtaccggcaagaaaacggttatttctctttttcatgcaaaaaacctcctctgcgtgcatacagacgcaaaggaggcgtgaattctgcagttcggcaaccggctgtcctgcggagtaattactccgggtagacccatggctttgcgacaccggctttcaccggctgtgcctttttctgtacagacacgcccttggcgcatgatgcacagatcaagttgtctaagctgaatgaaccggttgttccgggcacatggaatctgattggttcatccgcgcagcaggtaatttctgctacacacaaattatagcatagttcagcagaaatgtttccttttattttccatattttcgcacaaaattcatttgtgatttttgtgcgaactgtatgaatctacacaaattttcaattttcaggtgaaagaaggacgtgcctttgggcacgtccttccgcttacgctttatccagcagcttgatgatttctgcaatcttctgctcgcgttcgttctgatctccggtctcaaacgcatcctgcacgcagccggaaaggtgtccgcgaagaacctctctctgcgccttatgcaccagcgattcaaccgcctgcagctgcatcataatatctatgcagtagcggttgtcctcgatcattttgagcacgccgtcgatctgcccgcgcgcggtcctgagcagcggctcgacctttttacgatctgccatcatttgatgtcaaccaccttatagcctgcctcggtaacggctgcggtcagaacagcatcctccggcagcgttttgcccgaaacgactgccttgcctgcatccagatcgaccgcaacattacagccggctgctgcaccctcgagcgcctttttgacgtgtgccacgcagtgctgacacatcatgccctcaaccttgattgtcttttccataacattttcctcctttttatgtgccgtaagcggcttttcgccgcttatgggcaaaacagcaggcgtccccgccgtttttctcggtgttgcgctgaaaaagcgcaggcgcagtgcattcgataccacgcagacggacgaaaggctcattgccgccgcgccgatcatcggactgagcttgatgccgaacggcacccacagcagacccgccgcaatcggaacgccgatgcagttgtagaagaacgcccagaacaggttctggcgaatgttgcgcatggtccggcgcgacagccggatggcgtccaccgcgtccatcaggtcgctcttcatcagcacaacgtccgcagacgagatagccacgtccgtgcccgcaccaatcgcaatgccgacatcggcacgcgcaagcgccggtgcatcgttgatgccgtcgccaatcatagcaaccttgcggcccttgccctgcttctcgcgcacgatacgctccttgtcctgcgggagcacctcagcgatcacatcggtcacgcccagctcggacgcgatggactgcgcggttttctggttgtcgccggtgagcagcgttacgtcaatgtgcatactgcgcagtgcttcgactgccgccttactggtcggcttgagcacatcagcgaccgcaaaaatgccaacaatctgacggtttgccgcaaagaacagcggcgttttgcctgctgcggcgaactcatcgcccagcttctgcatcgagccggacagcgcgagtccgttagcgagcagcatgcggcggttgcccgcaaagcacggcacgctgtccacagttgcgcggataccctgtccctcgagcatctcaaagtcagtgaccgaacgctcctgcgcgttcttctcgcgggcatagcgcacaatggcgtccgccagcggatggtcactgcggctctcgagtgacagcgccagcgagagcaagtcaccggactccacgccgaaggattttacgtcggttacgaccggacggccttcggttacggtaccggtcttgtccatgatgaccgcgtttacgttgtgcagattctcgagcgcctccgccgactggaacagcacgccgtttttcgcaccgacacctgtgcctaccatgatagcgaccggcgtagccagtcccaatgcgcacgggcacgagataaccagcaccgaaatcgcgcgtgtgagcgcaaagctcggcgtttcgccgaccagcagccagatgatcgctgtcacgagcgcaatacccataacgaccggcacgaacacgcctgccaccttatccgccagcttggcgattggcgccttggacgcgcctgcctcctctaccagacggataatctggctcagggtcgtatcgtcgccgacacgcaatgccttcataacaacatagccgctcttggacacggtagcgccgattacggtatcgccgacatgcttttcgaccggcatgctctcgccggtgatggcgctttcatccagataggcgctgccctcggtgatctcgccgtcaaccggtacggactgaccgccgcgcacgataacgaggtcgccaacctgtacctgctcaatcggcagctgcatggtctgaccgccacggatgacctcagcggtctgcggacgcaggtccatcagcgccgcaatggcttcgccggtcttgcgcttggcacgcgcctcaaagaactttccgagcgttaccagcgtcaaaatcatgcctgcggattcaaaatacaggtcgtgcataaagctgtgggctgcctcaggtgtgggcgcgagcgcgatttgaatcagcgcgtaaatgccgtacacaagcgccgcacccgagccaacggcgataagcgcgtccatcgtcggggcacgatgcagcagcgttttgaagccgttgatataatatttgcgattgataatgacaatcggcagcgtgaggagcagctccgtgagcgccagattgaacatgccgtccatgcctcccgcataggacggcagcggcagcccgaccatctcgcccatcgagaagtacatcaggacaagcatgaaaatcgccgaaacaataatacgtgtcttcatttccttcagcgcctcgtccgcctgcgggctttgcgccggagctgatgtctgcctgccgtcgtccaccgcagccgtgtagccgccggactcgaccgcctttataatcgtctgtgcgtcgcacgcgttttcgtcgtactcgaccgccatgctgccggcgagcagatttacctgcacgccgctgacacccggcaccgccgaaacgcttttctccacatgggcggagcaggccgcgcagctcatgccgcccacccgaaaccgttgtttcatatcgcatctcctatctgtacccctccccccaagggagggggttctcatttacaaacacagtatacacccagggaacagtcttgtcaataacaaagttagtcttgacgaacgcccataaaatatggtatgatatttataattaatggtagttgaagtagtccataggacgaagtagacgaaagtttacttcgtcctatttttttgcgttcagctgcatttctattcgttatcaaaaaatatttcacatatacaaaaaggagaaaacaaaatgccaaaaaacaaatttcaggacgttatttacaccattatcatggcttctgtcatggtatacggcatggtagcgtacaacatcgtgctgaacaccggttccatgcagaactgggtatttctcgcggtgttccacgagtggccgatcatgactgttatcgcaattttgctcgagctggtgtttgtcggcaagctggcgatgaaggttgcgttccgtcttgtcaacccgcgcgaagccagccagaccagcattatgcttgccatctcggctgcatccgtatggctgatgtgcccgtgcatgagcttctttgccaccctgctgttcaaggacagccataacgcacagttctttgcaatctgggtacagaccaccgttatgaacttcccgatggcgctgctgtggcagttctttgcagccggtccgctggtgcgccgcattttcggtctgctgttccgggagaacgcagacaagtcctctgcgacggagatggagtcggtttaatcttcaatcgataattttgatttgccggtttactcggcaccggttttgcggagcacacgagttgcattagcaatacgccctttccgggcgggaaggttttcgcttaatctcaacggagagctgcgctctgcggagcgcggggacgtgctctgacgccgcgcgggcgcataaaagggatggacacctaaggtttgcccgtaggccactaaacctttttcccgcgccgtgcgcggatttaatgagtgcgtacccctcttatgaatctccccgtttcctcttagcacggcgaaatttgcagaactgagactataaaggaacggcagaagattctttctaccgtaggggcggccattggccgcccatttctttacctctacgcaatgccagattccgtactgctacacatatcggctactctccgcaggcgcgacacaaggtgaattgcccgaagggcaagagaaggtcccctgggggatccccgtgtcgcgcaactcgtttgtctggatattacggacggcacctacggatttcacctatccatcaactcctacctcctaccttgcagaaccgctcaccttgacaccaatgaaaaaggagaacccacccgggttctcctttttcattacgccatatccttgagcagaccatgcttctcataggtggtggtgcggacgatcttattttcctcatccacgaacacgacctgcggagcatagccgttcctgacctcctccggcgtcagctgcgcgtacgccatcagaatgaccttatcgcccacgctgacacagcgcgccgccgcgccgttcaggcagatcatgccgctgccgcgctcaccggcgatggtataggtctcaaagcggttgccgttctcaatatccacgatggcaaccttctcgtattcgtaaatgccggccgcatccagcagatcggcatcaaccgtgatcgagccgacgtagttcagctcggcctgcttgaccgttgcacggtggattttacccttgagcatctgtactgtcatgacttagtcctccaccgaaaagttgtcgatcaggcgcgttttgccgatatagaccgccatagcgatcagttcgccgccgttgatctcatgcaccggcagcatggtcaggccgtccactgcggaaacgtaatcaatacgcgcgagcggctcctgctcgataagcgcacgcatggcattgacaattgcatccgcgtttttctcgccgttccggaccagctcctggccgagctttacagcgcgcgacagcacgagcgccgccttgcgctcctctgcgctcagataggtattgcgcgaggacttcgccagaccgtctgcctcacggatgatcgggcagccgacgatctcaatgcccatggacaggtcgagcaccatgcggcggatgatcgccagctgctgtgcgtccttctgaccgaagaacgccttatccggcgttacgatgttgaacagcttggaaacgaccgtgcatacgccgcggaaatgaatcggacgggtcttgccgcacagctgacgcggcatttcggactgcacctcaacaaaggtggcaaagccgtccggatacatctcggacacctcgggatggaacaccatgtcacagccgcactcggtcagcagcgcacagtcgtgctcgaaatcacgcggataggtctccagatcctcacccgggccgaactgggtcggattgaggaatacggacgctaccgtgcggtcgcactgctgcacggacgttttgaccagactggcgtgtccttcatgcagatagcccatggtcggcaccagaccgacggtcagaccctgctgtttccactcgcgcacctgtgcgcgtacttctgcgatggttgttgcgattttcattgtatatgctcctgtttctcttaaaattcagcgtcgagtttggcgagatattcatcgctgcagtcagacttgacaaagctctgcttttcggtcgggaacgtgccgttctgcacctcgttcatgtaagtgcggaacgcatccaccatacgctcaccgatattgtcaaactgcttggcgaacttgggcgtgaagtccatgttcatgccgagcatgtcctgatagaccagcacctgtccgtcacagcctgcgcccgcgccgatgccgatggtcgggatggtcagctttttcgagatgagcgccgccagcttgggcggtacgcactcgagcacgaccgaaaatgcaccggcctcctgtacggtaaaggcatcctcgagcagccgctttgccgcatcctcgcccttgccctgtactttaaagccgccgaacacgttgacgctctgcggcgtcatgccgatatgtgcctgcaccggaatgccagaatccgtaatggcgcgaatctgctcggcaacggctgcgccgccctccagcttgaccgcgtgtccgcgcgcctccttcatcagtcggcctgcgttgcgcacggcttcggaaaccgacgcctgatagctcataaacggcatatccatgatgaccatggtgttctcgcacgcgcgcacgacgcaggcgctgtggtggatcatgtcctccatcgtaaccggcagggtcgtgtcataacccatcatggtcatgccgagcgaatcgcccaccagaatcgcgttgatgcccgccttttccaccagcttggcggtcgtgtaatcgtagctggtaatctcggtgaggcgctcgccgttctgcttcatcgagagaaatgtgctcactgtgttcttcattcgttctgctccttttccctattcagcagggcggcaagcgtgccgtaatcctgctcaggatgtttttcctgtgccattttgacctgttcgagtcctagcagcgcgtaaagctgccggtcgtctcgttccgtcaggcacgacagatgcttttgcacggtctgcgtgtcgccgcgctcaatggggccggtcagcgctgagacggcaccgtgctcgatcacatgcgccagattgctccgcatgagcggcgcaagcgcgtgcagtgcgtctgtttgggagaatccgcagccgcccagcaattcggcgctgcgctgcacgagtgcgcagacaaagttgcttgccagtgcacagctgaggtggtactgcgccttgctctccggcgaaatggtctgcacctgcagccccagtccgcgcagcagcggtacaaagacctcgaccgcctgcgcgtcaccctcgacgcaaaaaaaagcacctgccagctcccgccagcagttatacttgctgctgatcggaaatagcagatgaatggatattgcataggctccctgcgcgtgaatccccggaaaggcttcctcggctgtgcaggcgccgctgcaatgacatatatacttgtcctgaatttcaaattctgcgacctgccgatacacctcggtgatcgcattatccggaacggtgatgaaaatcgcgtcactatcttcgatgagtttgcccaggtcggtatagtgtccggaatttgtaaattctgcggcttctcttgcgctgtcggaattgcggctgtaatagccggatatccgcacgcctttttcggcaagcagtctgccgaaggaaaagccgacttttcctgctccaacaatgccaatgttcatgctgtcacccgctttctgtggtgtgacgcaacgtaaaatcactgtcggaaaaatttgaaaaacatgttgtgacaaggtatagcttccgctctgcggaatgccatccatcaaggggtattatacccgcttgagataagaatgtaaaggaaaagttttcggctccgtggaaccattcaacagtgaacgcacgttcatttatgctaatttcgttctgtaattctgcttataatcattaaaaccgctctgtatcaaaagatacagagcggtttccggttatgcgtaatacgcgatcctgagcagctcctccggtgtagtaacaccctgttttaccagttccagacccttttccttcaggctgcgcatgccctgctgttcccgcgcgtaggcctcgatctcctcggtttcggcgccgcggctgatcatgcggcggatattgcggtcgatcgcgacgatctcatgcacggcaatacggccgcggtagccggtgccgttgcagtgcgtgcagcctgtgccgcgcttgatggtcgtgatatccttgccgagcagcgcctgctcctgcggcgtaactgcgacctctctgccgcagtgcgggcacaccttgcgcatcagtcgctgcgcgaccagaccgaccagcgaatttgcgatcagatagtggtcgatgcccatatcggccagacggacgatgctcgagaccgcatcgttggtatgcagcgtactcagcaccagatgaccggtgatggccgcacgaaccgaaataccggcagtttcgccgtcacgggtctcaccgaccatgatgatatccggatcctgacgcagcagcgcgcgcagaccggactcaaacgtcagtccggcaaccggattgacctgcgtctggttgatgctcggcacgttcctctccaccggatcctcaaccgtggagatattcacctgccggtgcgacaggtactcgagcaccatgtacagtgtagtggacttacccgaaccggtaggaccggtgatataaataatgccgtttggtgagttcagcataggcaggaaccttgcatagctttcgtcatccatgccgaaatggctggcgtgatcgacctgacccgccgttgccagaattcgcagcacggccttttctccgaacacggtcggcagcagcgatacacggatgttgacgtactcgctctgtcccacacggatacggaaatgaccgtcctgcggcagacggcgctcggcaatatcgaggttcgccatgatcttgattcgcgcgatcagcggctggtgcacactgcgctgcagcgttacataatcgacgatcgtgccgtcgatacgcatgcgcacgcgcgtgctgccctcaaacggctcgatatgcacgtcgcttgcgccggtgctgatggcacggtcgagcaggctgttgagcagcttgacgatcggcgcttccggatcgccgctttcgctctcttcgacctgcagcacctccacattgcgctctgcaaagtcctcgttggcggtctgtgccgcctgctgtgcaccgacctcggcgtaatagtagcggattgcgctctgcagcggacccatttcgctcaggcggatgaccacctgacagccggtcagctggcgcacttcctcaaaggcaaagtagttgagcggatcgttcgtcacgacctcgaggttcttgtccgcaaagccgaccgcaagcaggttctgcttttccgccagctcgcgcggaatcatgcggacagcggtcagatcgacctgcatctgtccgatgctcacgatctccagtcccagacgggcagccagtgcctcgagcacctgcgcctcggtgacaaagcccagctcgatcaggatctgaccgactcgcttttcacggtgctccttctgataggcgagcgcctgctccatctgctcctgcgtgatgtaattgcgctccatcagcacttcgccgatacgcaaattggttttcatgcgtctgcctccttgtcgctgacacacatgtagatctccagcgtgccggtgatcagattggtgctgaccgtctgcgtgttgtttgccacataatcatagtctgcaatactgaaattggtcacacgcagacccttgtacctgtgctccacctcatcgaggaagttcagccactgggttacagcgccctgcgccgagatagtcgcagtgccgatataaacgtagttgaccggctgtatcagcgttgccgatgtatcgtcggtcgaatcgtcggtcgaatcggcggattccgcatcggacgaggtgtccgcactgccgtccgtctgcgcagcttcctgctcggtgagatacgcgctgaccgcacccggagcggcttccgtcagcgtcagcgactgcggaaacagcccgttctcgagcgcgatacccgtgatgatatcgtccatctgacgggtttccagatcgctcttgtagtatttttcgcttgccgtgttcagcgcggcttcattctccgcgataatgtcgtcaatcgtcgcaagtgcggcaatctgcgtctgatattcctgctgcttctgttcggcggcgtcatactcgttctgcagcgtttcgtgattttccatcgcaggacggatgagatacatgccgaaaataacgattatcgccagacaggccaccagccggagcagctttttatcacgttcggttacaacgatgttcattcggctgcctcctctcccagcaggatacagttcaggctgaggacgtacacgccgtcctcataagtatagccggtgtagtccaccttgcggaacaggccggttttctgcagcttgagcacatagctcggaatgtcgataacgctgccgctctgtgcatcgaactgcagcgcgccggtagccgcatcatagccggtcagcaccatgctgacctgagcgccgcctgccgcgccgatcttgctcatcagggcgctgtccacctgcggataggtggcaagcgcgtccgtcagattgcgcacctgctgcagtccctgcaccagattgtcattgcgctgctgcttttcggcagcctcgttgtactgctcgatcacggtcggatcgttcagccagttattgatgtcgtcggtcctgtggctcaggctgctgttcatctgcaggaacacacaccagaccgcagcgcacaccaccagacacaccgcaatcggtgtgtagaagctgtgcagcaggccggtctgccctttgctgccgcgggacaaacgccgatagctgcggagcagatccagctccttgtttgcacgaagcacggttcgaatcaaagtctcggcacagccgagccagtcgtccagccgctcgccgttcggcagggcgcggaacgcacggcattcgggcagacggctcactttcagacccagaccgcggatacccgccagacacacctcgaaatcatcatccgagcagccggcgtaatacacatcggtcagcgtgccgcccgagcggcttgccgtgtggaactgcatggtgccggaaacgtttctcgtcatctcggtgccgaaatccaccgtgcccggctcactgaaaatacggctgcggctggaataacggtactcgccgttctcgaccagcagcgaaagcacgctgctgccctcaaagcacagccagatacaggtcttgccctgcatggactgcatggcatgcaggagcttgagccgtcctgccatagtaacggtaacgctctgcaggcgcaggccgagccggtcggtcattgcaaggtattcctccatcgtttccttgcggcaggcagcgcagaacagctgctgacggccttcggcatctgtgccgagcggcacatagtccgccgccgcaagctgatcctcccgcggacgcatttcgtgccgcacaagctcctccagcttgtttaccggcatgctcggtgcggtgatagtcttggtggcaaccgcctcatccggcaggacgagcgtgatgccgcgggtcggcagcctgtgctgctgccagagtgcgcctatcgccttctcccagttttccatgccgccgccgtgtgcgggggcactgtaaagcgcctgcacggaaggctgcgcgccggacttgccgaccgcgacaagcacctgctcctcctgcagcgccaaaacggttgtgttcattctcatttctcccctttttgtgaggtttacacgtttccgagattatacgttccccgaactctcaatcgcactgtacgagccgatgatcggcgacatgactgcgataatgataaagccgaccacgaacgccatcagcacgatcagcatcggctccagaatggtcatcatgcgcttgctcgcctgctgtgcatcatactccatcgaatccgcgatggaatccagcatggagtccagtcgtccggtctcctcgccaactgcaatgctgctgcacagcttgcgctgaaagccgtctacggtctcgagggcggcggacaggctgacgcccgaacgcacctgcacgagcacatcatcgaactgcgaaacgatgtaggcgttgccgatggtatcacgggcggtctgcagcgcagtgacgatcggcagaccgctcgagtacaggctgctaatggttcgcgcgaaccgcgccgtgcagataacctgattgagcggaccgaaaaccggcattttgagcttgcgccgatccatttccagccggacggccggaatgcgcagcagcgtgcggataaccacgaccgctgccgcgacacccagtatcatcagataccatttggtaaccataaaattggaaaacgccatcagcgccagcgtaacgcccggcagcgaatccattgtggagaacagatcgctgaactgcggcagcacgaaggttacgataacgataacgaccgcgaccgccagaatcgcaaggatcatcgggtacatgagcgccgacttgacctgctggttcatctggtgcgccttctcgtagtggatggcaagccgctccgcgacctgatccagcttgccgctgccctcgcctgcgcggatcatgccgagcatgagcgtcgggaacacctgctgtgcctcgagtgcggcagaaaggctcgagcctttccggacttcacccagcacactctcgtaaatgcggcgcagacctgcgctgatgccctcatcctgcgagatgatcgtcagcgcgcgcaccagactgacgcccgaagccagcagcgtggacagctgacggcacaggtcgctcagctcctgcggacgcagtgtgcgcggcttgcggcccgcaccgcggcgggtcgcactctgcagatacagcccctgagcgagtaattgggtatacaacgtgtcatagtccgcagcctccattgcgccgcggactacctttccgtctatgtcctttgccgtgtagcggaacagcgtgtgaccgctgttcggtttgaccgtgacggtcagcctgtggttgttggatgcagccatgctgaccctcctctccattcattacaataatcccatataccagtccgcgatcgtttctccgaaaaacatggcgatcgcaatgccgatgcacaaaaacggaccgaatgcgaactggcttttccggtttgccttcttttgggcgagcagcagcgcgccgaagccgccgccgagcagaatgccgataaacgcggcaacgaccgtcagctttgcgccgagaaaaaagcccgcgccgaacatcagcttgatatcaccgccgccgaagccgccgggcacgatgagcgccagaagcagcatcggcacgctgacgatcacgcagccgatcagccgcgattttatccccaggctggggataagtatgtgcgcagcgatgccgcagacaaacagcagcaccggaaaccggtcgtagatttcaagtgtgtccatgtccatgagcgccacgaccgtcagaataccgagcacggcgaacgccagcgccgcctgtgcggtctcgccgccgaaggcgtatgcgcaggcacaggagcacaagccgccgagcacctcgatccagaaatcccttgcggggatttttgcgccgcagccgcggcatttgccgccctgcaggagataactcaggcacgggagcagctccgccgccgacagcgtgcgcccgcacaccggacagtgactgcgtcccttcaccacgctctctctgcgcggcaggcgccataccaccacaccgagaaagctgaatacgcatgcgcccaatgcgaaccgtaacagccataatacagcataggcgatgtaaagcattggtttcctcctcgcttgggttggtttggaatgattttttacaaatagaatctaccatgcaaaaaccgcatgacaggtcacagccacttaaacgttaaggggctgtgacccgccataccgtccgcaagccgaacgcaggcaccgttactgcgttccgcatcattacagcggtatgaatcaggtcaccaccgtcagccaccagcttaccgcgccgtatttaatcggcgcagtcggtccgtggcgttcggtgcgattaatcattagtcagcaacagtatagttgccgttagcgtaggtgcaaggcttagtatgggtcttgctcgtccaagtcaacgttgcaattttgccatcagttacggtaatattcgacaacgtacccttatcggtaagttctgccagttccagagtcttactcagatctttgtctaccttagccttatagttgtcaaaggtcagggtcttgtcaacagtagccttaacgcccgtgccatatgcttcatcatacagtgtctgagccgccattactgcctgacggcactcagcaacaacctgcttctgacgagccttgtcaatataaccagtcagcgccggaatcagcagcgctgccagaattgccagaataaccagaaccacgatcagctctaccagcgtaaagccgcccttcttgctgcggcgcttctgctgcagcgcgatcattttttccatcatgatcttattcctccaatttcatttttgtttttttctatctctgtaagctgcggcggtgctccgcagagttacacatattacattgccgttatgccggctttttcgttgccgttacctcggttttcaccggaatatcgtaccgcaggtcgataatgagcgaatccgaatagattttatcggtcaaatccttatcgcggtaaattgtcacggtggcggtaacggtgtgctttgcttcgtcgattttgaaatgcagtccggcgcggagacccatataaaagccctctgcgtaggttttcgtcatggctcgggcaatgggattgccgtccgcatcctgactgtagccgtctttataatagcgctcgacaagataacccttttccactcgaggctgctcaccggagtccttatcggcaatcacgattttggttggtccgcagccgtctgccgtcagcagctccgccgcgttatatccctgttcggtctcatagccaaactcgatcgccgagccttcggacgagccggttttattcgtcacgtccgtgccgctgtcgtagcacttgatgtaatccgtggcggtctccaccttgctgcgcacggtttcgagcagatcgtccgcaatcagctcggcgctgttcagctcctgcgtgcggcgcgatacctcggccgccggccgcagcgatgcgctgaatatgccgatgaccagacacagcagtccggcgccgaccacaagctccaccagtgtcatgccttcccggccgcgcaggattgagcgaatgcgtttcatgccgtcactctcccttcgcaaaccggtagaagggcacggttttgccgtcctcggttttggcgtttacggtctgcttttttacctttacgcggaaggcgtcaatatcggtatcttcgccgttcgacgtcgtcaccttaaaattgtacgcggcagcttcgccgtccgcgacttctgcattcccgcgcacgctttcctgcagttcggtcgcgtccctgcggagctgctccgacttgcgctgcgcatttgaggcaaagccgactgcgccgttcagcgcgcccagcagcagcatgaacaccaccgtggaaaccagaatttccaccatggattcgccccggcggtcgcgcagcacgcgaatcagtctattcatcggctgcacctccggttgtccgggctgccggcttgtgaatgggttcgtatcggctgtacgtcggattgttgatatcataggtatagctgatctccacatgctccgtgcgggcatccttgccctcgccaatgaccttgggttttaccgggtcctcgccgttggcacttcggcaaaagcggccgtttacccagtagacctggaacgatccgctgacgccgtcttcccctttccatgtgtagattggctgaaaactgtcctttcggcggtattctgtggtgtacatgtagctgtccgctcccttttccgccttgacgcctacccaaacctgatgtctgttaaaggttgtctgctctgccttttcggtgccttcgttccgagcatcgtatacaaaggtatcgcctgtgatcgggtcctgcacatcggtaacatcacggagcagaatcgtaatcctgccgtagttatcctcggtcgaacccgcattatagcaggcagtggtttcatccgaacggtccggatcgtaaatacccaatcccgtatcttccgctaaaatgttgttcacttcacggtagaaacagccttccggcgcaaaattggtatccaattccggctttattgttttgtattcctgcagttcgctgtccagcacctgtgcaaaggactgcgccagctgataacagcgttccctgccgatcttgcggttggcccgcgagagcagcatggatgaggaatacacgatactgagcgaaagcccgatcaggacggcgacagcacaaagtgctacgatcagcgaaacaccgcttcgcctgctgcgccgcagggtgttccatccctgacgtatccgcttcatgtctgccgcctcccttcgtaactaaaatctgcgctcagcaggatcggattccgtataacggtcgctcttgctgtccgcaatgacagttaccctgctgatctgtataccattcgtcagctgcagggtctgattctcgtgcgttaccacggagaaaatgttaggcagcttcaaggtaaatgtgccgtccttcacctgcagcatggtatccggctgatagctgtaataacgaatgctgccattggtaaggctgtatctgccgttgaccgcactgccctgttttacagtataccagtcatcccctgcaactgcaaacgtattttgaccattcatgataatctccggcaggttcccgctcatatcgacggtaaccgtcgtggatttatcgtccttatcggtcaattcaatccgatacaggtcagcctctgccacctcgtcccacgagagcgcggtaagctgtgcatcccactctgccgtgttgataagacgattcatcgggccatagctgaccgcaagcgtctcattcacgtttgccagcgacgcgctcggtgcttccagcttcacacgcgggaataccacatcgccgctcgatacccaggccgagcttacctgtcccgccgactgcgaaatacgagcctcaaaccgtacagaacagcctgcgtatttcgtatccagatcggtcaggctgcagacgtagctgccgccgctttcgctcattgcggaaacggggtaagtcaccgttgtgccgtccgtcccggtgatttttgcccgcagcagataggtgctgccgccgggcggtacgctggcctcattctccggcgtaacggtgacctgcaggccgccgcttcggaagccggccgccggaatcgggttgtttgctgtcgcattccagttgtacgaccacttgacgctcggcgtatccagacgcatcggcacggtcatcgtgtacacgataccgttcgggctgtccgcgtagccggaatcatcagcagccaccgccaccagatagaggtcaatggtcttgccggcgtaatcctccagactgcggcttaccgagcaggtgccgcccctgacgggcacacgcgcacccagggcagcggccgtttcgccctccggctgcacataaatctgatagcctgcacagccgttttcgctgccgatggcactccagccgatggtgtattccagctcgttggtatccgggttgattaccaatggctgtcccggacgctcgaggcgctgcttgacagcgtacttcttcgtcgtactcaggccaacctcgccgtattcctgtcccagacgagtaacggtcagctcaacctcggcgtactgccagtcgtccgcgttgatggtgaacgattgggaagtattcggattctcctgcgtaccgtaaacctcgttgaccggaatgccgattcttgcacctgccgcagtaatgccggtcagcttgacgctgtagtgcggtgctgcagtcccctgcccggactgcgtccacgagaactggtagctgatactgccgttatcttcctgtatcagtaccgggtccttcagctccggtgccgtcagcggcttgatgttcagcgccgcggctctaatgtagtttgcaaagtcagtcgcatggcccagaacatggctgtaaatggtcttgtcctgctgctgaacgccctccgcgctgtaagtccgcagcgtaacggacgcatcgccggtctgccaggtatcgccataggtgtaaaccggtcccagaccggaggcggcgtaccatgcacgcacccgacgatttgtgacattctccgcgaaatactccttcggcaggtcgcggaagtttgccataaccgtgttgcccgccgaggtcagcacatcctcatacgcaaacacatactcatttgtgccaaccgtgccgagcacctcgatacggtaaatcggcggtgtttccatctgcggctcgttgaccgtcagtgcagccgtgaccgtgcaatcatccaccgtactgcccgagtacgataccgacagattgttaatactgccgtccggcttgtacttcggcgtgtcggtcgggatagtatccgtcacagaggccggctgaatgccgttcgtaatgcccgccgctgccgtgacgatcagctccttcaaatcgtcgccgctgatctcggcggtatggttgttctgatcaatggtcacggtctgcgagccaagtctgaaggtaaccttccagttgctgaagactgcataatccgcaaggtttttcagcgagatctggtatttagcgccattgttccaatggctcaccagtcggatattgacatccggtgtcggcagcaccgacacattctgcgtcgccgcagttttccatgcagaaggtgcggtgtcctcaaacagactgacagcacgaacagacaatgtaatggtcttgcctgctgtgtctgccgcaaggcttgccggcagctggaacgtaccgctggtcataccggagccgtacgcctgtgtgccgttcagcttcgggtcccactgtccctgtcccttttggttcgggataaagcgcagattggacattacttccttgccatcaacaagcactgtaccctcgtagtacaggggacggtccgtatcctcgatggatacatcgaaactgccgtctgtctgctgtttcaagtcaaccgtgaacgaggcatccagctttttgctgttttgtccgtgctccatggtgcggtatgcctcacgaacataatcgtccatgatctttccgcctgacaggttgttcagtttgccggttttctggctaatggcaggcattaggctgtttgcattccatgtgcgtacctgatcataagaataatccggcggcatttcaaacaggattcgtccggtaattttttccgtaccatcattgaatttgctgatcaggataccattttcaacccttgtattagaatctgtcatgttgtaataaatgccgcattttgtccgggcatcctcattttgtgtcaagttcaaagtcggatccagacgcggaccaacaatcgccgcatagaattttccgtcaaactcaccatatgcagccatgcgcgcataaccacgccgtgattcacctgcaccgttgttgcgcgcttcgtccgttttataagtaatgccagctgtattcccgctctctgtcagcccccatgtatcaaagaaataatagttattgcccacccggtctgcatccagccgcgtagaaccgccagtctggaacgaaataatgccgttatccgacaagatcggcacagaatagcaattctggatataagtattccgtgtcgcagccgaaccgtagcggtcaccgaagataccggcgcggaagttagtacccaccagatcgtccttgtacgcatagttgcggcaacggtcgatattcagcacaatatttgccgtcgatgccgtgatggaagcaccattgttcgatgttgcgttatcgaccgagaagaagcccacgataccggaagccatcgagcccgaataaattttaacacccggtgcattgaggcagtccactacattgatattgaactgctgtcccatggcggccgaacttgccgtatacgccgtaatattacccagaatgccggcactgtcatttgcactgtagctcgtgttgttaccccagcggccatatatactgccatggttctggcagctcagaatattgaaatcctgaccggaggccgcatgatacagctgtgccacgatgccgccggatgcaccgacccagttggctgcataagtggtctgcaaattgccgtaattatagcaatcctcaaccgtaccgccgttattcgtccactggccgacaatgccgcccgaatagtgcgacagatagccgtaaaccgtgccataattgatgcagttctcaatcgtccagtcgcttgtggtcttgttggactgcgtgccgatgataccgcccgcaaagcggctggtattctgctgtttcagctggcggccgacaaacgcctgattgagcagataggacaggtccttttcgctctcgttcatgccgacaataccgccggtgccgacaccgatgccgtccgacttgttgaccagcagccagcggccgctgacgcagcgattcagctcaccggtcggcgcgttgtagcccgccacgccgccgaggttgccgttgctcgatacgatgatctgcatggttcggtctgccgctacgctcttgctgccgtcgttgtaggacagcttttccacatccgtccggtctgcccactttacccaggtggaatccgcagacagcttctgtgccttggcattcgccagcagctcgctcaccttgctgacatttttcatcaaggcttcggtgctcttatcgccggacatggtgatcgtgcccttgttatagccggtcacaccgccgaccatgccgtttttgaccgtgatcgtgccggttccggtattgcctatgtagcactgctcgatgatgccggtcgcatcattcttgcccgcaatgccgccgatatgcgacgacaggcgttccttctctgccgccgagctggtggaggttgcggtgtacacaccgtccgccgtcagcgtcagcctggaaacggtgctgccctgcagcagaccgccgttcagtccggcaatgccgccgtagcagttgccgaccgcgctctttccttcgtcgatcgtgccggagtaagtgcattcggttaccttgccgcttgcattattctgcccgactacaccgccgagataggtatacttcgtgaatttctcgaaatccgaggtgaccttcactttgctgaccgtaccgcccgctcgattgatgccgactgcaccgccgacctgcagcgtgcttgcagaaacgctgtatgtcggctgctgcgaaacctcggtttccgtgaccgtaccgctgttgtctccgacaacagcacccagaatgaatgcactgccggaaatcgtgatatgatcgccgagtaccgctccctgaaccgtaccgcccttgtggtttaccgcacagatcgcgcctgctgcagtcttgttgcgggtgatgagcgttaccctgttatccgtgccgacgctgcagctcctgatcgtaccgtagttttcgctggcaacgccgcctgcatagccgtcgttactggtgacgctgccgttgccgatgcagttctcgaccgtgctgctcgcgctgttcatgccgacaatgccgcctgccgcaccgacatttgcggtcacttgaccgagattcttcgcgtaccgcagaacagcctttgcgccctcctgcgcgccgacaacgccgcctgcactgcccgccgctgcgcggacctctgccgcctgattggtcaggcagttgatgctcgtgccgccgagtgtgccgcggttgatgccggcaataccgccgaccatactgctgcctcgcacggtcagcctgttatccgcggcaatgacatcgccctgtgcgctgccgcttgccggactgagcgtgccggttgcggtattcacgccgatcacgccgccgacaccgctgccgctgccgttgacacggcgctttcctgccggtgtgctcgaaagcgtgatcgcaccgccgttttcgcccgcaataccgccgacacggcctgcaccgctgacattggcgctgctggtattgttctgtatcctgcctccgctgagattatagccgacgatgccgccgaccgtgttccgtccggtgacggtgcagtttttctcggtcgtgcagttttcaatcgtgcccgcaatcgtgcccgccgtcctgccgccgacattcagacccgcgataccgccgatataatcctgcgttgcgctgcccatgctgccggagagcgtgcagccgcggatgatgccctcgttcagaccgaccacgccgcccatggcattcagaccgttcatcgtgcccttgctggcacagtgctctatcacatgattctcaccgttgacgccgatcacaccgccgatgacggaagcacgcagctcgccgccgcccagctcatcggagagcgccttcgcggcatccgtgtacttctgcgcccgcagataagataccatatccacaccggttttcagcttgctgtccgggaaggtgtcctctgccggacggtcaaagccgcctgcgttcaggcagtgctccaccttcattcgggtctgcggctcacagctgccgataatgccgcctgcatacgcatacgcgcggatggtcatgttgttggaaaccgcagacagcctgcctgcactgttgccgtccgctgtgatggtgatggtatgcgtattggtagaagccttgaccgttcccggtacattgctgttgtttgccgcgatgcccggcagaagcgcatacagcgttttgccttcccggtcgttctccgtgtaggtgcgctgataaccgatcagaccgccgcagaatgcctctgcagtgaccgtgccaaggctgttatcgaccttgagaccgctgaccgtgacattctttcccgggttgaccacatttgcaccgatcgcaccgccgacatagtaccgtccctgcacactgctcggcttgatggtcagcttcttctcgagtagctccgtcgaagcattcagaccgaccagaccgccgacacaatctccggttgcggcaacacggccgccgatgagcgtgtaattgatgtcaatcgtgccgtccgtgtcgttatagccgaccagaccgccgacatagtgcctgccgacaacgatacccgccacactccggttggagactgcgttgtccttgtcgctgaaggtgatcgtgccgctgttgtagccggtcagaccgcccgcatagctgccgacagctccccagtctgtgacacgcctgtagatcgcattattggtgtccgaaacatagcttgcacagtttatgatggccgcatggttctcatttgcaccgcaaataccgccgatatacgcatcgtatcccgcagcgacacctgtgttgacgcagtttttgatcgtcgaaccgcctttattctcaccgatgatgccgccgacatacgaattgccgatgacatagcttgcgttaacggttgttctggtgccgttttcactgagcagtgccgtctgcgtatcagactgattcagcgcaccgatgatgccgccgacatactcgctgccgagaacgtagccgtttgcctcggtctcgcagtcatacagcacactttgttcgccgtagccgacaatgccgccgacatatctgccgcgcagcttgtctctatcctcctgcttataggtgtagccgtccgcatatccggcacgactcctgcattccgaaagagacgcattatgcgcgtagccgacaatgccgccgatataatgtcctgccagtgaatgatcatctgcggctatgctgctgagaatcagaccctcatttggcagtcagccatatcttttcccgtggcctgatccttgccggaaaaatagcctgcaatgccgccaaccgagcgattgcccgttacagcggcgctgttggtcagggttttgactgcggcaccgtttgttgtcaggctgcccgcaataccgccgataccacgcgcagtatcgccggtcggcagcgtaccggtcacggtacccgatgcagacagcttgattactgacttagaatcgctgacctcaatcacaccggccacaccgccgatgccctgcgcctgtgccgaggtcagcgcagcctccaccctggcttgggtgccgtccacgttatcgcccttcaaagagccattgctgtaaccgcagactgcgccgacacccttgagcttgtccgaggcaatctccacctgcggattgagcaggcgcagattatagatcgtgcctgcgtttttccggaacagaccaagatactctgcgtcatcggcaatcgaggtcttatccagcttgagattactgatgacattcccgccggtaaacacgccggcaatgcggttcagcagaccgcctgtgccgtccagtgtctgattgctgcgcagcgcaggaatactcgggaagccgatatccttgccggcggagaccgaaagcgcgccgcgggctgccgtaccgtaaacctttacactgtcgctcgtccagtccagcgaacgtgcggtaacggcaaatgccgcctccgtatccatataacggatattggacagatgacggaaggtttcgatctcgtaccggctgttatccgaccgggtgccgtcaccgaaaagcgtgttcgccttattggattcgatagcgtcactcttttgatactcctcaccgccggtgttttctgcattcgggtccggaaatacctgcacggctgcgtaaacattcagcggtttttccagtttgccgccgaagcgcgtgatgctggtatcgctgctctgccggaaggctgctttgttatcagcggacagcttatccagccggtcgtacagcttcgcattcatcataccgtccagcacaagtgttgcccgcttgttggaacggtcgtattccacggggaaggtataatccttcgtcgcgttgtcctcggtcgtaaccgcaaccgactgcgaacccgttttcaaattcctgcccggaatattgatcgacaggagctgcgctttatcctcactgctgtacagcttgacctcgtaataaaccttatccagatcctgatccttcacattgctcgaccagttcagcgacagggtttcaccatttaccagattgatcgaggtgatcttcagcttggtcgcatccagactgacagcattgactgcatcctgaaccgagtaatagcccagctgttctttctggcgcgtatcgcggtcgcgcttgctgtaatcaatatccagccagctgccggacatatccgccggtttgctgtcctcattcgatccgtagtacagtcccttgcagtttgtgccgtagaaaaccgaataaacctgaccgctttccacgtcgatttcgatgcagattgcagcattcagcacacttttatcgtaggtatcctgcgaaagcagcgcaccgacgagcgcaccgtcacccgacagctcaccttctgcgtattcgcctgcatccagacgaatgccgtaaatacgaccgaccagctttttccggtcctcatccgactcatcaaacgactgattcagcacgccttccttcttcaccttgctgcagaatgactcccattcaccgccggtacgaaggtaggtcagctcagattctgccgacagatacatggtcttagcgtacgattcattctttcggaactgcgacagatggatataccccagaaggctcggtacagcgatggcaaacagaatgctcagaatgaccagcgtaaccaccagctctacaagagtaaagccgccttttccgcactttttgcgctgctgtgtcatattcgctgcctccttccctttggatacaagataaacgggtatactgcccaaatttagtcgttttatattttaccaactcctacgttttctgtcaagtatcgacaccgttcaactgcaatctccgctgttttcgcttattttctctgatatttaccatgattttcatgccacaaaaaaaggctgccgaagcgagcttcggcagccttctgcaatctttacgatttcttaattagaggaagatatacttgagtacgaacagtactgccagaacgtacatcagcggagcaaccttcttgcccttgccggctgcaacattcagcagaacgtaggagataacgcccagagagataccctcggagatgctgtagaacagcggcatagcgatgatggcgagataagccgggatggactcggtcaggttgtccagatcgaagttgatctcggttacagtgcctaccatcaggaagccgaccatgatcagcgccggagcggttgcgaaggacgggatggcagtgaagatcggcgcaaacagcgtggatacaaggaacaggatgccggtaaccagagcggtcaggccggtacggccgccgactgcaacgccggatgcggactcaacaaaggtggtggtggtggaagtacccagaattgcacctgcggaggttgcaatcgagtctgccagcagagcgggcttgatgcccggcagcttgccgtccttatcgagcatcttcgccttggtggcaacaccgatcagcgtgcccagagtatcgaaaatatcaacgaacaggaacgagaagatgacaacgatgaagtttacgatgccgactgcgctgaaatccacgttgaagcactggccgaaggtcagacccagcttggagaagtcggtcatgccccagctcgggaacagggaatagaagcctgcgtccggcgtcggaacgtaaagaccggtcacctggcagagcataccgaggatccaggtcagcagaatgccgtacaggatggcgcccttcatcttgcgggtatagaatactgcggtgaagaacaggccgatcagcgtcagcagtgcgcagatgcctgcggtgtggaaattctccgggaagctgatgatgccgaccaacgtagcggagtctacgcacagaccggagttctgcagaccgatgaaggcaatgaacagaccgataccaaccgaaacaccctttttgagcgtcagcggaatggcattgaagatggcctcacgcacattggtcagcgacaggacgatgaagagcaggccctcaatgaatacggccagcagcgcaacctgccagctgtagccatagcctgcaacaacggtgtacgccatgaaggcgttcagacccatgccggcagagagcgcgaacggcaggtttgccataaacgccatgcacagcgtgcccaggcaggatgccagggcggttgccagcaataccgcggtggtatccatgccggtggagccgagtacgctcgggtttacggcaaggatgtacgccatggtcataaaggtagtgataccggccatgacctcggtcttgactgtggttttgtgttccgatagcttgaaaacacgttcaaacatcgaataaccccctttttaattttcaggctttcgccttgattactgtgaaatgtcttgggcaacaccgcaaaatttacttgcaaatcactcttgttcaattatgcggtattgcccttgcttacttcccctcgtaagcgacaaccgtctccgccggacaggttttgatgcggtcgcgtccgtgcagacccttaagctccagcaggcagacaaccttgacgacctttgcgccgagctgctccaacaggtggacagccgcctcaagcgtaccaccggtagcgatcaggtcatcgacaacgacgatcttcatccccggcttgatgtcatcgcggtgtacctcgatggtctccatgccgtactccagctcgtaggatatgcgggacgttgcacgcggcagcttgccctgcttgcggatcggaatgaatgccttatgcagattatacgccatcggtgcaccgaacaggaatccgcgggattccagaccagcgatcgcgtcaaactctacgccgtccagcagcgcagtcatctcgtccaccgccagatggaagccgtccgcgtcaccgagcacggtggtaatatcgcggaagatgatgccttccttcggaaaatccggaatgctggtgatatactgctcaaccttactcatgaaacctcaatttcctccttatccctgccgcccggcagagaatcaattatgctgttttgtcatttggcaagcaaaacagcaatacactttatatattatcaaatcgtgtcgtttgttacaagagattgattgtacgaaatgcagatttttatcatgaagattattgcagctatacaaatcctcatcaagttgttcactatcggatatggaacgggcgccgtccggacgactgggcggttcaccgcacccgcggcggcgggcaagagggcagacacctgcggtttctaccctcttaactcccgtttccctttgtttccgaatccggcgcagaccagagaccggcgaccgcttcgaaaaggagaacggcagaggattctttctaccgtaggagcgcacaatgtgcgcccatttctctatctctacgcagtgtcagatttcgttctgctacacaggcgggttcatctacgcaggcgcgacataacagtgtcgcgcaactcgttggtaggtggctgcggacggcacctgcaggctacaattatcaataaactttaccgtagggtgcgacgacctcggcgcaccgtatctaacgattgatacacgttaccccgtaggggagcacattgtgctcccgcgcaacgtcaaatcaaacggttcttggacgtttcttgcgcagactccagtcgcgctgcgggcgcacactgtgcgcccctacgattaagcatgtgcagatggtttacaaatggtgcgccgagtcgtcgcaccctacggtttacatttatgatgaaatataatgacatgaagaagggtaaaacattacgttctcttcacgctaattttccattctccattctcaattttccatttctctcctcatccagctcatcagcattccaacgatatagacctgctgctccgccgaaagcggcacgccctgcggaatgccgtgccacttcgccagacagccgcggcagcagcaggcggtcgcgtgctgcgcgatgaacaccggatgcccgcgcatgggtgtctgcttgccgtcgtttttcggttcggccggtgcaagccgcttggaaacgaaatctgccgcgtggtcagcgattgtattccatcccttctcgcggatgtactgcttgtcctgcgccttcaaatgaaagcggctgcggaaatccgagcgcgaaagccgcacgagcatctgcgcataggtttcctgccgctgtttgtctgtcattgtgctcacctctttttatagtatactccgatcgacttttttacgcaatccggatagaacatttgttttcttttcccgaatatgatatactatctctgcatttgattttctgtatcttcaaacgaaacgaggaaacctatggaaccgaccaaatttgatatgaaatatgccgctgtccggcgtgcgatcatcgaacagcgcttttccaagttaaacgacaagcagcgcgaggctgtctatcagaccgagggtccgctgctcatcctggctggtgcaggcagcggcaagacgaccgtgctcatcaaccgcatcatcaacattctcaagttcggtgacggactgaaaagtgaacttgcgcccgactgggcgaccgaggacgatcttctgttcctgaccgaatacctgaccgatcctaagccggagaaccgcgcccgcgcggagcacctgtgcgcgatgaatcccgcccgcccgtggcaggtgattgcgatcacgttcacgaataaggccgcgcgtgagctgcgcgagcgtctggaatttgccctcggtgacgaggaagccgcatccgctgtctgggcgtacaccttccacacagcctgcctgcgcattctgcgcaagcacgttgacctactcggctttgagagcgcgttcaccatctacgatgaggatgacaagaagcgcgtcattctcaacgtaatgaaaaagctcgatctcgatcccaagaatttcgatccgcgaaccgtgatgggcatgatctcccgcgcgaaggacaagctgatgaccccgcgtcagttcagcgcggatgccgccggtgactacttccgtgaaaaggtcgcagacgtctaccgcgattacgaaaaggccatgaaaaaggcctgtgcgctggatttcgacgacattatcatgaaaaccgtgctgctgctgcagaacaaccccgaggtgctggaatactatcagcgccagttccgctatgttctcgtggacgagtatcaggacaccaactacgcacagtacgtcctcaccagcctgctggcgggctactacgagaatatctgcgtggtcggtgatgacgaccagagcatctacaagttccgcggtgcaacgatcacgaatattctggagtttgaaaagcagttcaaggacgcgaaaaccatccgtctggagcagaattaccgctcgaccggcaacattctgaatgccgcaaacgaggttatccgcaacaacgtcggccgcaagggcaaagagctgtggaccgaccacggtgacggtgcgaaaatccgtctgcatcgctcggacagccaggagggcgaggctgcctacatcgcggacaccatccgcgagggcgtggagcagggccgaaaatggggagatttcgccgttctgtaccgcaataacgtcctgtcggataacattgccgccgcattcatccgcgcgggcattccgtaccgcgtgtacaagggccgcgacttcttctcgcgcgccgaggtcaaggacatgttcgcctacctgtgggtgatcgaaaatccggcggacgagctgcgtctgcgccgtattatcaacacgcctgcccgcaagattggcgataaatcggtcgaaaccgccatgcagcttgccgtcgagtatggcacgacgctgtataatgtggtatgccatgcctctcagtaccctgccctgtcgcgcggcgcggctgcgatggagaaattcggcgaaatgatcgaaaatctgcgcaaactgcgggaatttgtctcgctttccgaattgtacgatgaactcatggacaaaagcggctacatccgtgcgctgcagctaaagggcggtgcagaagaggagagccgcattgagcacatcgaggagttaaaatcctacattgtcgattacgaggataagaccgaaacgccgtcgctcggcgattttctcgagaacatggcgctgtacacggatgccgaccagtccggcgaggacgatgacgcggttatcatgatgaccatgcatgccgccaagggtctggaattccctgtcgtattcctcgcgggcatggaagacgggctgttccccggcttccgtgcaatggagaaggacgaggacatggaggaggaacgccgcctgtgctacgttgccgtcacccgcgcgaaggagcagctgtatctcacctgcgcggagcgccgcctgctgtacggccgcacgcagtattcgcatccgtcgcgctttgttgatgagatgccggaagagctgcttgagagcaatatcaccgagagccgccggttctcgaacgcgactgcacccgatccgacactttcgcgtccgcaggtggctcgcgcgcggtacgtctctgctgcaaatgcagcgccgagcgcgtcgctggcctcggcagccaagagcaagccgctgccgaattttgccgcaggcgaccgcgtgttccataaggccttcggcgatggactgatcgtgtcggtaaagccgatgggcggcgatgccctgctcgaaattgcgtttgatcagaagggcaccaagcggctgatggccaagtcggccgggcagtttatgcacaaattatgagcaaacgacaggaattctgcctggcgctgcaccatctcgcgctcacgtttttcgtgatatgtgcgctcccgctatggtatctcacgggtattttatccgatgttccaccggatgtcagtgcagacgcgctgcatgcaggccgccgccagctcgtgattctgtttgcggtatttaccgttatttttcttatcggtatgattgtattccgatcggggcggctgccgcgcagtaaatttcagattgcggcgctgatcgtgctgctgatactcgtcagctttccgtttctgctgtactgctcgattgcagctgaattgcggcttggcagagtgatacttgcggtttatacagcatatctggttgaaatttgtgtgctgatgggacaaatccttctgtcgccacacaaataaaaaggagttctctcacgagaactcctttttaggctgtcaattaagttcgttttcgcgatgctgatgctgtcgcgcggcagcgcgtatgaaatagcatttgcagcccaaatgcatgaaaaccgggggcgtgtacctcggttttcatactttcagagggagaaagtttccgcacgggaactttcggacgtccgtgttttgcgaagtcaaaacacagattgtcggaaaaacgaattttttcgacagtctcaactcctttttcactctctcagcatttccctcagcttctctatggcgcgtttttcgatgcgcgagacctgcacctgcgacacgccgacaatgcggctgacctgctgctgcgtcaaatcacgcgaatagcgcagactgagcacctgcctgtcgcggtcgggcaagtcctgcagtgcctcgtgcagcgacagatgcaggcaggttctctcctccattccctcgtcaccgaccagatcacctacgcgtcctccgccggacagctcccgctcgaacgagtccaccgacacgtccgcctgctcgcaggccgctacttcctcgaccgtcaatccggcggcctgtgccagttctgatacggtcggtgaccgtccgttcctgctttcccagtcgctttgcaggcggcgcacacgaaccgcgcgttccttgaccgcccggctgaccttgaccgcaccgtcgtcccgcagaaaccgccgaatctcacccgcgattttgggcaccgcataggtagaaaactcgttgccgagcgacacatcgaaaccgcgcacggccttgatgaagccgacacacgccagctgatacagatcgtccggctcggtgccgcgcccgtaataccgccgcacgatcgaccagattaaaccgctgttgtcctcgatcagccgcgcttccgcgtccctgtcgcccgaagccgcctgctcgagcagcgtgcgcatttctccggtcacgcctgccgctccttcagcaccttgaccatcgcaaccagcgttccctttcccggcgtggagcgcacgcgcattttgtccgtgaatgtctccatgatagtaaatcccatgccgctgcgcgtgtcgtcgcccgtggtgaacatgggctggcgcgcctgctcgacattctcaatgccgcatccggcgtcctttactttcagttccagagcgcgtccctcgaacagccgcaccgtgaccgtgataaacccgcatttgtccgcgtaaccgtgcacaatggcgtttgtcaccgcctcggagaccacggttttgatgtcgccaagctcctccatcgttgggtccagctgcgcaacaaatgcgccgaccgcctgccgcgcaaacgcctcgttgaccgaatggctctcgaatttcaggctcattttgttgatgaccgcccgcattattccttccccctttcaaaaaccatcacctgcggcagaccggccgcctcaaacacccgcatcggctgcggcggcgtgccgcgcaccgcaaattcgcgtccgctgcgggcacaggtgcggtacaggtgcaggacgaccgccagaccggagctgtccataaacgtcagctcggacaggtcgagcaccagcttttcacacggaaacagcaccagcagatcctcggtctgctcgatcgccgcccgtgctgcatgatggtccagttcaccggtgtacaccgcgatcagcgtgccctcctgccttctctgcgtgatttgcagcatatatgtcacctcgaaatcagcaaatattacctcttatttcgcagggcaccccgccctgcgatataccaaacaatatacctattgaaaacaactgacacaaaaataaaaggcttgtactttcaaagtacaagccttattttacctgtttatttcattttaatctgtcgctttcggtcggccgcgcaaaatcttctcgcactcaccgatgaggtacagcgaaccgcagataagaatgcagtcgttcatcttcgcatgctccagcgcaagctcgatggcgtgctcagcggattcgcattcgtacacgcgcttgcacgactgccgcgccagctctgcaatcgtgtgtacatctagcgaacgctcacccgcatccggcacacaggcgtaaaagtcatccgcgcggctggcgacctcgtgaacacaggtttcgtagtccttgtcgcgcaccatgcccatcacaacgtgcagccgcttcatcttgagcagctcatccaccgcgtgacacagggcatccgcgcctgcggcattgtgtgcgccgtcgagcaggatgagcggctgatcgaccacgcgttccagccggcctgcgatacgcgcccgcgccagaccgcgcacggcggcttcggtcggaatgttccagccgcgctcgcgcagtgcgttcagcgcccgcagagccgtccgcgcattctgcagctgatgccgtccgggcatggcaatggtgtagccctgcgcctcgtacacgaacgccgaaccgccgatatcacaccgcagtacgcggcagtcctccgctccgccgaaccagacagcgcccgccgcatcacaggcacggcgcagcacccgctgtacatcgttcggctgaccgtccgcgcagacaaccgccgcacccggcttgaaaatacctgccttctcggctgcaatgaccgccgttgtgttgccaagcaccgccatatggtcgagcgaaatcggcgtaataacgcaaacctccgcatttttgatgacatttgtcgcatcacagcggccgcccagaccggtttcgagaaccacaatatcgcattcctgctcaacaaagcagaggaacgccagtgcggtcgtaaactcaaactcgccgatggtctcaccctcgggcagtgtgagcgattcacacgccaccgttacccgttcgcacaggcgcgtcagatcgtcgtccgagatcatcacaccgtccacgcggatgcgctcgtaaaactgcaccagatacggcgaggtatacagtccggtgcgcagtccggccgcctgcagtgccgaggcgatcatgcacgcggtcgagcctttgccgttcgtgcccgcaagatgaacaaacttcagcctgtcctgcgggtttcccagcgcctcgcacagcgccttgatgcggtgcagacccggcttgccggtaaatctgccgagagagtgtatgtattcgattgccgttttcggattttcggtatccataatagcttctttccttgtattataatgatacatttgattataacacagtttcatcaaattgagaatggagaattacctttccgcaaaaggagcggcacttacttcatctgaacattcattctccatcttcaattctccattggaaacataaaaaccaccgaaaatcggtggtttttatattttttacttgatctcctcgaccggaatctgcttgagcagctcgctcgggccgcagccggagcactttgcacagtcgtgcatgcatgccatcggatcatccggatcttcctcacggccgatctcgaggatggtcgggtcaccctgcttttcaccgacgaggaacttcgctacggattcctccgccgagccttcacagccgggcacgagcagtacgccgagcatctcgagtgcgttgcgcgttgccagaccgagtgaaccgcagatgagcacgtcgatctgctccagaccggcgaacttgatcaggtcggtcgcggacgtgccggcaatcccggcaatgcgcttgccgaccggttcccgaccctcagtggtgataatgagcacctcacggcagtcgcccagattcttggcgatccggccgttttcatatgctacgccaatgttcataacagaccctccacggtcttaagcgcaccggaaagctcgtccggcagctttgcatcctcgatcttgcctgcgtcaaccgccgcagccagcttcgggtcgatcggcagcttggccagaaccggcagctcgtagtgcgcagctacctcgtcaatgtggctctcgccgaataccgaaatgtgcttgccgcagtccgggcatgccagatagctgtagttctccacgatgccgagcaccggaatgttcatcatcttcgccatcttaaccgccttgccgacgatcatggagaccagatcctgcggcgaggtaacaacgatgatgccgtccaccggcagggactggaacacggtcagcggtacgtcgcccgttccgggaggcatatcgacaaacaggaagtccacgtcgtcccatacaacgtcagaccagaactgcttgacggtctccgcgatgatcggaccgcggtaaataaccggatcgtcctcatgcggcagtaccagattgatcgagatcatctgtacaccgccttcgctgcgtgccggaagaatgccttcctcgcagccctcgagctgaccgtgtacgccgaaggtcttggggatagacggaccggtgatgtcggcatccagcacaccgcaggaataacccttgcgcgtcatgccgaccgccatcatcgaggtgagcaggctcttgcctacgccgcccttaccggaaacaacgccgatgacttttttaacagaggccgccggattggctgcaaccttgaggctcttttcgccgccgcagtgagacgagcagctatcgcaattatgcgagcaacccataaaaaacaactccttacctatatatcttgcatagaatacagtataccctaaaaagaaactttccgcaagcatcgcaccggcttatttattgacaaatgccaaaaacgggaaagcaccgctgtttcgcgggggaacgaaacaacggcgctttcggttaataacacaaattgaaaaaagggaaaaaagagaaatgaaaaaatcggatgacgtcaatgcgggatttgcggctctccctcactgacaagtacagtatactgtcttcttatgccgaatgtgtgaacaaaatttgaatatgctgtgaaggatctgcaaagaaaacggcttatcgtccaaactgcagtctggcaataaatcaagagaaacgccctgtttcccgggggaaggaaacagggcgttctcgttgatgcaaatgaaaagagtttaagaaaaggtgataaaatcaaagaaaagaggttgtcagcttgagaaaaggggtaactcttactgacacctatagtatatcgcgcaggcgccctttaattgtgaacaaatcatgaacagaccttgaaatattttttacaatgtaaacaagtaccctgcttaaccatttcaaaggtactccgaggcaggaaaacaccccggctccgtgggggaaacggaaccgaggtgttttcgatcatttcacaaaataaagggggtaaaagagaaataaaagattgtagatgactatcgattcgggattgcggcttcccttatcgacaatgttagtataccgcactttgcttcaaaatgtgtgaacgaattttgaacagaatttgaaaggtttgtgtactgccgaaaacccggtttcgtacaggaaaacaccctgcctccgagggggaacggaaacagggtgttttcggtcatttcacaaaataaagggggtaaaagagaaataaaaaaatcagtaggctgtgtcgttcgggattgcggcttccctcatcgacaatgttagtataccccactttgccgcaaaatgtgtgaacgaattttgaacagaatttgaaaggtttgtttctaaggcaacaccgcataattgaacaagagcgatttgcgagtaaattttgcgtgttacagctgtgcgaccatggttttcagggcatccgggttcatagcaggcgtgtccttcagcggaaattccagaccgagccgttcatatttttccatgcacagcttgtggaacggcagaaactccagcttttcaaagttgggatagctttccgccttgactttgacgcggcgcaaatggtccataccatcggtcagaccgggcacaaccacatgccgaatccacagcggcacgtttttcatcgcggtcagctgcaggaaacgctcaatctggtcgaaatccgcgcggcagttcttgagataatccgctttagtgaggaatttcaggtcgcacagaaccaaatccgtgtgcgccagcaccttttccgcctgcgcgagattgcccacgccggaggtatcgagcgcggtgtgtacgccgtgctcatgcagcttagcgaagaattcctcaacgaattcggcctgcaggagcggttcgccgccggtgacggttacgccgccgccgttcttccagtacggacgaaaccggagagccttgcggaccagctcgtccacatcggtcggtgtgccgccttcggtcagccaggtatcgggattatggcaataggcgcaccgcagcgggcagccctgcataaatacgacgtatcgcacgccggggccgtccaccgcgccgagggactgaatggaatgaatgtttccggtcatattgccactttcctttcattgctgaatttatcaatccgtttgggtaaacggggaacgtgcggtacccaccgctggggggcaaagaggaaggacaacctacggttttccttcctctttgaactcctgcctttcccttagatagcctgacgcaaaccagagaccggcgaccgcttcgaaattggggtacggcagccgggttactgttgcgtgtcttgctctgccttttcgcagttcacagacagtttgctgctacacagatcggtatctgatactgcgaatatgcggatacatgagcggtcgcaggccgtctctgcggaggaaaaaatcctctgccgtttccccttttcgcagcggtcacatgtcggcaatctgcgccagactatcccaaaggaaacggggagaaaatcagaggggtggaaaccttggtgcccatccctcttgtgcgcccgcgcggcatcagcgcagttccgttcgcttcacaagcgaaaactcagatcgcctcgtggaaggtacgcgaaataacctcacgctgctgctcgcggctcagcttgtagaagttcaccgcatagccggaaacacggatggtcaggttcgggtactgctccggatgctcgtaagccgccatcagggtttcgcggttgagtacatttacgttcagatgatgcgcattctgcgcgaagtagccgcccatgatggcaacaaggttgttcacctgctcctcatcggtcttgccgagcgcacccggcgtgatggagaatgtgttggagataccatcgcggcagtaggtgtagctcagctttgcaaccgagttgagggaagccagcgcgccggaaacgtcgcggccgctcatcgggtttgcgcccggtgccagcggttcgccgtgacggcggccgtccggcgtgttgccggtctttttgccgtacataacgttagaggtgatggtcaggatggacatcgtgtggatcgcaccgcggtacagcgggaactgcgtcagcgcctgatagaacttctcgacctgctcacacgcgatctgatctacgcggtcgtcgtcattgccgaacttcgggaaatcgccctcgatctcaaaatcaacgataatgccgttctccgggttgcggacaggctttaccttggcatacttgatcgcggagagcgaatccgccatgcagctcatgcccgcaatgccgaatgccatcaagcggcgcacctcggtatcatgcagcgccatctggctcttctcgtaggcgtacttgtcgtgcatgtaatggatggtattcatcgcagaaacgtaggtcttagccagccacggacggtagaagtccatgcggcggagaacctcctcataatccaacacatcgccgtccatgaccggcatctccgggccgacctgctcgaacttgttctcgtcacggccgccgttaatggccatcatcatcagctttgcgatgttggcacgcgcaccgaagaactgcatgtccttgccgacgcgcatcgcggatacgcagcacgcgattgcgtaatcatcgccgtagtacgggcgcatgacgtcatcgttctcgtactgcagggcatccgtgtcgatagacacctttgcgatgaacttcttccagttctccggcaggttttcgctccacagaacggtcagattcggctctgcagcagcgttcaggttgtacagggtgttgagcatgcggtagctgttcttcgtaaccatgtgacggccgtcctcgccgatgccgccgactgcctcggtgatccacatcgggtcgccgccgaacagctcgttgtactccggcgtgcgcaggtggcgcgccatacgcaggtgcagaacgaaatcgtccatgatctcctgcgcctcggactcggtcatgagacctgccgcaatatcgcgctcaaagtagatatcgaggaaggtggaggtgcggccaaggctcattgcagcgccgttctgctccttgatgccggccagatagccaaagtacagccactgaacggcctcctttgcgttctccgccggacgggtgatatcaaagccgtaggaagccgccattgcgatcatgtccttgagcgccttgatctggtcgctcagctcctcagcgcagcggatttccttctcggtggtcggcacgctgccgagcgcatccttgtccttctgcttctcctcgatgaggcgattcacgccgtacagcgccacgcggcggtagtcaccgatgatgcggccgcggccgtaagcatccggcaggccggtcagcagaccaacgtgacgcgcttcacgaacgtccttggtgtatgcggagaatacgccgtcgttgtgggtcttgtggtacttgaactcctcctcaatcttgggagaaacctcgtagccgtactgcttgcacgcatcacggaccatacgcatgccgccgaacggattgcatgcacgcttgagcggctcatcggtctgcaggccgacgataacctcgttgtccttgtcgagatagcccgggccgaaggccgtgatggtgataacggtctcggtgtcgatattacggacaccgcccttttcgcgctcctccgcgagcagtgcgtcgaacttctcacgcagcgcagtcgtgcgtgcggtagccggagccagaaaagcgccgtcaccatcatacggggtgtaattcttctggataaaatcgcggacattgatctcgttttcccagttgccgccattaaagttgttccatgcgttcatgttcttttcctcctgtttgtgctgtctgctgtccttttttatggtaacaaaaaaggacagcatcgcgtattacttgcgacactgcccagacggtcggcattaagatacacttcacgatgcatctgattacggaactccctgctccccggtggtttgcgctccacctgtgtccgtcagttgcagggaatctgtctggctttaggataccacatttccgtcaaactatgcaactgccgaaagtgacaaaaaaatccgtccgaaatcatacagaaaccgtgactgtgccgaaacaggcgctttgtcaaatgtctgtaaaatctcttttcaaatgccacaaaatagcgtatagttagtgtaacagatgtacaaattgtagatatccattgcaaggaggcaggaatatgttgaagatcggtatgctgaccagcggcggcgactgtcagggtctgaacgcggcactgcgcggtgtagcgaaaacactgtataacgaactgggagataaagtaaccatctatggtattcgggacggctaccgcggtttgatcgagggcgattaccacgaaatgctgcccgaggatttttcggatattctgaccgtcggcggcaccattctcggtacatcgcgccagccgttcaaggaaatgcgcaagaccatcgaggacagcgaggagaccaagttggataaaatgctgcacacagtgaaaaaggcaggctttgactgtctggtcattctgggcggcaacggcacgcacaagaccgcaaacctgctgagcatgaagggtgtaaacgtggtaacgctgcccaagacgatcgacaacgatctgtggggcaccgagctgacatttggttttcagtccgcgattgatatcgcgtccacggttattgattccatccattccaccgcattctcgcactcgcgcgtattcatcgtggaggtgatgggacataaagccggctggctgacgctgtacgcaggcattgcctccggcgcggatgtcatcgttattccggaaatcccctactccgcaaaaaagattgccgcagcgattgaaaagcgtgccaaggcgggcaaacgattctcgatcattgcagtggctgagggcgcgataagtcaggacgaggccaagctgagcaaaaaggaattcaaggctgcccgcgaggcgatgacctatccgtccatctcctaccgcattgcggacgagctgaaggagctgaccggtcaggagatccgcgttaccattccgggccattatcagcgcggcggcgctccctgcccggccgaccgtgtgctgacaagccggttcggcgtagcggcagcccagcttatcctgcagaaaaagttcggctatatggttgcgctgcaggataaccatatcgtgccggttccgctgaccgaggtcgcaggcaagctgaaaaccgttccgcccgatggcgaactggtgaagcaggcaagagcgctcggattgtcgatgggcgactgattgccgaattgagaattgaaaatggagaatgaagaatgaacgcagctatttaatccgttccaaaaaggacgcataatatgcgtccttttttcgtgcgaaagcacatataaaattccggtttgcttgcaaaccgcaactacatgacaggatttcgttcagaaatctgagtcattgtcccgtgccgtgcacgaccgccgtttcacgcggcattcaatcgcgtttgccgtgcaaatgcaaaaaaacgcaggacatgcgcgcgcagcgcggacatagccgcgcaaggatagcgcctgcgttttttacaagaaaaaagggattttgtgtgcccgccaaggcggacgcgcaaaatcccgtataggacgtatccgagccattggctcggtacgtccctctcgtccgaaagcgtggtttcggacgaattatttgatcgtcataacctgatcacgagcaggacctacgccaagcatggtaatcgggcactcgatgatgcgctccagctccttgatgtaggactgcacggttgccggcagttcctcgaaggaacggcagttggtgatatcctcatcaaagccgtcgaactcctcgtaaaccggctcacagtctaccagatccatgaagtttgccgggaactcggtaacagtctcgccgttcttcagcttgtatgcaacgcagaccttgagcttcggcaggccgcgcagcgggtcgatcttgttgatgacaacgtcggtcagaccgtttacacgaaccgcatagcgtgcaacgactgcgtcgaaccagccggtacggcgcggacggccggtaacggtaccgaactcgccgcctgcattgcggatgtagtcgccggtctcgtcgaacagctcggtcgggaacggaccctcgcctacacgggtagtgtaggacttaaagatacccatgatctcgttgatggcagtcgggccgacaccggaaccgatgcagcagccgcctgctaccggatgagacgaggtaacatacggataggtgcccatgtcgaggtcgagcagtgtgccctgcgcaccctcgaacagcacttccttgccggacttgatggcgtcataggtcataacggtggtgtcgcgcaccatcggacgcagacggtctgcgtaaaccttgtactctgcgataacagcgtccgcgtcgatcggctcgccgccgtaaacgccggtaatcacgcggttcttacgggcacaggtctcgcggataacctcctcgaaacgctctgcgtctacaaaatcgtgcatgcggatgccgctgcgctcggacttgtccatataggtcgggccgatgcccttcttggtggtgccgattgcggtgccttccttggccttctccgcctcgctgagcgcatccagctcaagatgccacggcatgatgcagtggcagcgtgcgtcgatgaacagcttgtcggtggaaacgcccttctcgtgcagaccatcgatctcgccgaggacagccttcggattaacaacaacgcccgggccgatgacgttgacgcactccggatacaggatgccggacggaatcagctgcagcttgtacttctcaccgccggctacaacggtatgaccggcattgttgccgccctggctgcggacaaccagatccgccttgcctgcgaaaatatcaataaacttacccttgccttcgtcgccccactgagcgccgagaattaccttacctggcataggatttcctccctttctatctgcaacgtgctcttgtcacgcgatatactttatatatgtatggatcatacccttgaaattatagcatacccttctctacttttcaatgccgttttacacgtttttgtcttgtaaaagacggcccgccgttgtaaaatattttataatagcgggaagtatggccgcacggcggtctgtcccgatgaaggagttcgtttttctatgcattatcttgataacgcggcgacgacccgcgtgctgcccgaagcagccgaagcggccgttcacgcgatgtgcgaggagttcggcaatccgtccagcctgcaccgcatgggtctggaggcctcgcatctgctcgaggacagccgcaggacggtcgcgtctgcgctcggctgtctgcccgaggaagtatatttcaccgcctgcggcacggagagcaccaacatcagcctgcgcggtgctgctcacctcaaccgacataaaaagggccgcatcatcacgaccgagatcgagcacgcggcaaccgtcaacaccgcaaagcagcttgctgcagacggcttcgacgtagttttccttgcaccggacgcaaccggtcacatcacgcccgaggtgctgagcgaagcactgaccgaggacaccattcttctctcctgccagctggtcaacaacgagatcggcacggtacagccggtcgaacagctcggaaagctgctcaaggccaaggcacccaaggcgctgttccatattgatgccgtacagggtctttgccgtgtacgcctgacgccgaaaaaatggaactgcgacctgatgagcgtttccggccacaaaatcggcgcacccaagggcatcggtgcgctgtatgtgaaaaagggcctgcgcctgcctccgctgacgttcggcggcggtcaggagcgcggcatgcgtccaggcaccgaggccgtgccgaatattgccgcatttgccaaggcgtgcgagattcgcatggcgcatttcgacgaggattacgcccatgtgcaggagctggccgactacctcaagcagcaggtcagcgccgagctgcccgatgctgtaattaacggcgaaggcgatatcccgcatgttgtcaatctatccatgcccggctgcaagagcgaggtcatgctgcatgtactcgagggggacgaggtttacatttccagcggctcagcctgctccaagggcaagcagagcggtgtgctcaaggcactcggtctgccgaaggcgcgcacggacagcgcgctgcgcgtgtcgtttgcaccgttcaacacaaaggaagatgtggatgcttttgtggcagcggtcaaaaagggcgcgaaaatgttccgcagataagctaattcgtaattaggaattattgcgaggaggtagggttatgagaaaagtggttataaacacgttgatttgtctggtatgtacagcgataatcttctatctgcactttgccgtatatgatggaatgctgctgcaggagccgttctttacaggttccatatgtgcggtatgtatcgtatttgcacttcgttccaacattgacgatcagacctatacaacgcaatggaactacccgacagcctttctgcggatacggctgtatcagctcttatggtgtacgattgcagtcagcataccggttattctcatcaccgaaccgtaccactttgaatactggtttgcactgacctgtattgtggttattgctctcatctctaagctgcatctgaaaaccgttcctgccgtacctgttacggttatggtaactatgctgattacgatgggtatttttctgctggttgttcatccgatcagcacatccaatgcagaaaagctggtcgaacaggccggatacaccgacctgtatcgcttcaaaatggagtttagcggcacattttggactacccttccggatgacaccggcatcggctgcaccatgcccgaggagaaagacccgctcgggtattacggcttccgcgcatacaaggacagcgaaaaatactgcgtgatcgtctctgcggcacgcagacagatcgaagtacaggaaaaacaaggagtttaatctatatggaatacaaaaccatcaccaaaccggacggctcggagcagaagctcgccgtatatgacggcaaatgccgcttctggatggagggcctttacgacagcctgccggacactgccgaaaagcgtgcggaggaatgcagtctgccggtcaaaattgaccgccgggaggacggcacggtcagcgtcggcacgcagtcgctcgtaccgtgggaaaccgattacggcaagctggaaatcatggcggacgtttacttaaactatctggcacaggtgttcaacctgccggatgatgattacgtcaagacccgcttggagttcggctcggacagcgccgaccgcgacagcctgatgactgccgaggagaaggaaatcatcagcgcaaacaaataaatttaccatcaaggagacaataaatgaaagaagtattactgctcaagtgcggtgagatcgtcctgaaaggactgaaccgcaaaacctttgaggatcgtctgctgaaaaacctcaagcgccgcatggcgcacgttgcagactgtgagatcaccatgcgccagtcggtcgtttatgtggagattccggacgatgcggacgcagatgcggttatggagtgcgcaagccgtgtgttcggctttgcgaccatctcccgtgcagcggtctgcccggaaaagacgctcgagagtgtcattgcgaccgcaaaggactatctggcacccaattttgcggcggctaagacctttaaggtcgaaagcaagcgcggcgacaagaaattcccgatgacatcgacagagatcagccagcacgtcggcggcgagcttgctgatctgttccctgatgttcgtccggatatgcaccatcccgacctgaccgtacacgttgagatgcgcgagaagtacgccttcgttcacgccggtccggttccgggtgcgggcggcatgccgatcggctcaaacggccgtgcagcgctgctgctctccggcggcatcgactcccctgttgccggctggatgatggccaagcgcggtctggagctgtgcggcatccactttttcagctatccgtatacgtccgagcgcgccaaggagaaggtgcttgaactgggccgcaagctgaccgcatggtgcggccgtatgagcgttatggtcgtgccgttcacccacattcaggaggaaatccgcgacaagtgccacgaggagctgttcacgctcatcatgcgccgctttatgatgcgcattgccgagcgcgtagctgttgagtacggctgcggtgcgctcatcaccggtgagtcgctcggtcaggttgccagccagaccatgcccgccatggccgttaccggcgcggtgtgcgacctgccggtattccgtccgtgcatcggcatggataaggaggaaattgtcacgatcgcccgtaagatcgacaccttcgagacctctatccttccctacgaggactgctgcaccgtattcaccccgaagcacccgaataccaagccgaagatgccgaagatcctcgaggcagagagccacctcgacgttgaagcactcgtagacgaggcggttaagggtgtggagatcatccaccttccgtaataattaggaatgagtaattactaattaaaatagcaattcccttgatttaaggaggaactttcattgaacgcagaacttatcgcagtcggcacagagatcctgctgggcgacatcgtgaacaccgatgcacagctgatctcgcagggtctgtccgagctgggcatcaatgtattctaccagaccgttgtcggtgacaatccggcgcgtctcgagcgcgtagtccgcgaggcaaaggaccgtgctgacatcatcatcaccaccggcggccttggcccaacccttgacgatctgaccaaggagacgctggcgaccgttttcggcaagaagatggagctgcatcagccgtcgatggaccgtctgaccgactttttcaagaccatcggccgcgaaatgaccaaaaacaacgaaaagcaggcctggctgccggagggctgcaccgtattcaccaacctgtggggcacggcacccggctgtgcgtttgaggccgacggcaagcacgttctcatgctgcccggtcctccgcgcgagtgcaacccgatgtggaaggaatgtgcaatgccgtatctgtacaagctggcaggcggctgcatcgtatcccgcaacatccgcgtgtttggcctcggcgaaagcaacatggagaatatcctgcacgacatgatggaaaaaagcgcaaacccgaccatcgcgccgtatgcccgcacctcggagtgcttcgcgcgcgttaccgccaaggcggacaccccagcagaatgcgagaagatgctcgatccggtcgttgacgaaatcctgaagctgctcggcgacgacgtttatggcgtagacgttgactctctcgagcaggtagtcggcgacggcctgcgcgagcgcaagctgaccctcgcagtagccgaaagctgcaccggcggtctgctgtccaagcgcctgaccgacatcccgggcgcatccgattactacctcggcggtgtgtgctcgtacagcaacagtgtcaagatgaaagtgctcggcgtgaaaaaggaaacgctcgacacggtcggcgcggtatctcccgaaaccgcagagcagatggctgtcggcgttgcaaatgcgcttggctcggacatcggcgtcggcatcaccggcattgccggcccgggcggcggcaccgaagacaagccgaccggtctggtctacatcagcgtttggtacgacggcaagttctttacccgtaaaatgcagtcctcgctcggccgcgaccgtgtacgcatgcaggccgcttctacggcgcttgatctcatccgccgtcacattttctaaacaaatttatatcgaattgtacgttattttgtcattcccactcaaatgatgtggaaagcaaacaaaatttctgtaaagaaagtccagtaattgtgctaaattgctggacttttctatttatgtgatgtatactatatctaactaaagtgagggtattccgccaaaattctgtcgaagtacacaaactgttggaaaatattcgtattttccttcatttggcggctgtaaagggagagatgctgtatgaagaaaaaatccgcagcacccgccgtggaaaagcgaagcgagcttttctattccggccgggattgtcgcgcgttcgattacatgggagcccaccctttcgtgcaggatggtgaacagggttatctgttccgtgtttatgcaccggaggccgaaaaagtttccgtcatgggtgagttcaacgactggaatcgcgacgccgattatatgacgcgcgatgaacagggtatctgggagaaatttattccgaatattccggaatatgccgcatacaagtatagtgtatgggccaagtccggcgatgtgtttgacaagtccgacccgtacggcttccatttcgagacccgtccgggcaacgccaccaaggcgtatgacatcgacggctacgaatggggcgacgcctcgtggctggattggcgtaaaaagcacctgccgtattccaatccggtcaacatctacgaatgccacctcggctcgtggaagatgcacgaggacggcaacttctactcctaccgccagctggcggacgagcttgtgccgtatgtcaaggaaatgggctacacccacatcgagtttatgccgctgaccgagtatccgttcgacggctcgtggggctatcaggtaatcggctactttgccgccacaagccgctatggcacgccaaaggatctgatgtacctgatcgacaaggcgcatcaggccggtctgggcgttatcatggactgggttccggcgcacttcccgaaggacggctgcggactggtcgagtttgacggctcgcacctgtacgaatacgccgatccgctcaagatggagcacaaggaatggggcacgcgcgtattcgactacggcaaggtctccacgagaaacctgctgttctcctccgcgatgttctggatcgagaaatttcacatggacggcctgcgtgtggacgcagtcgcttccatgctgtatctggactacaaccgtcagggcgaatggcggccgaacgtccacggcggccgtgagaacctcgaggccgttgacttcctgcggttgctcaacgagtacatcctgaccgatcatccggacgttatgatgatcgccgaggagtccaccgcatggccgatggtgaccaagccgggttacgacggcggtctgggcttcaacttcaagtggaacatgggctggatgaacgacatgctgtgctactgctcggcggatccgttcttccgcaaggacatgcacgacaagatcaccttctcgttcatgtacgccttttccgaaaactacatcctgccgctctcgcacgatgaggtcgtgcacggcaagtgctcgctcatcagcaagatgccgcctccgtacgaaaatcagttcggcggtctgcgcgcgctgtacggctatatggccgcacacccgggcaagaagatgctgttcatgggcggcgagtttgcacaattctccgaatgggcgtaccagcgcggactggactggatgctgctggattatccggcgcaccgccagatgcaggcgtacgtcaaggcgctcaatcacttctaccttgctactccgcagctgtgggagcaggataccgactggcgcggctttgagtggatcagccatgaggacaaccgcaacaacatcatcgccttccgccgtgtggcgaaggacggctcggatatcgtggtcgttgtcaacttctctccggaggagcagcaggaataccgcatcggcgttccgatcaccggcacttatgaagagatattcacctcggacaagaccgagttcggcggcagcggcatggcaaacggcaagctcaagaccgaaaacaagcccatgcacggtcaggaacagtccattgttctgaagattccgcgcttcggcgtgttgttcttcaagggcaaggcaagagccaagcgccgcaccaaggcagagatcgaggccgcaaaagccgcggctgccaagaaaccggtaaagcgcacccgctcgaccaaggcagttgcccgcacaaccgagaaggccgtagccaagaccggctccaaatccgttgcaaagaccactgaaaaggcggtggcacgcaccggaaccaaggcagttgcgaaagccaccgaaaaagcggtttccgtaccgacagacaaggcagtaaccgcaaccggcggttctaaataacaggtgaaaacctgcagaaagagatacacagaggggatacgccagacggcgtatagatcgcagcgatgcaaactgtgaaaaaggagaatttacatgtatcggaaaaaagaatgcgtagccatgctgctcgcaggcggccgcggcagccgtttgtatgtgctgaccaaaaaggtcgctaagcctgccgtaccgttcggcggtaagtaccgtattatcgacttcccgctttccaactgcgtcaactccggcattgatactgtcggcgtgctgacccagtacgagccgcatgtgctcaacgcttacatcggttccggccagacgtgggacctcgaccgcctgcgcggcggcgtctatgttctgccgccgtacgagagcaaaaagaccgagtggtacaagggcactgcaaacgccatctaccagaacattcagttcctggaggattacgatcccgagtacgtcctcattctttcgggcgaccacatctacaagatggactacaacaagatgctccagcagcacaaggagaccggcgctgacgcgaccatcgcggtgctggacgttccgctttccgaggcttcccgtttcggtatcatgaactgcaagccggacggcaccatctacgaattcgaggagaagccgaaggagccgaagtccacgctagcttccatgggcatctacattttcacctggaaaaagctgaaggaatacctcatcaatgacgaggccaacgagcagtcctccaacgacttcggcaaggacattattccggcgatgctgaataacggcgaaaagctggtttcctaccgcttcaagggctactggaaggacgtaggcaccatcgagagcctgtgggaagcaaacatggatctgctctctccgaactccggcctgcagctttccgatgacagctggaagatctacggccgcaccaccggttcgcctccgcatttcacctccaagcaggctaaggttacccataccctgctctccgagggctgcgagatctacggtgacgtttccgagtccgttctgttctcggatgttaagatcggcaagggtgccaaggtggaatattccatcctgatgccgggtgccgtggttgaggaaggcgcgaccgtgcgctactccatcgtagccgaaaaggccgttatcgccaagggcgcggaagtcggcggcagcccgtccgacagcgacgcagacaactggggcgttgcggtagtagccgaaggcgttcgcatcggcagcggcgcaaagctggccgctaaggaaatggcagacgaggatctgccggacgtaaagtaagggggcggcacaaacatgaacagcgttttaggcatgatcattgcatttgataccgacaacgatctccgcgagatcaccgagcaccgcacggtcggtgcggtacagtggggcggccggtatcgcattatcgactttatgctttccaatatggtaaacagcggcatttaccgcgtgggcgtactgatgaaggacaagtaccagtccctgatcgaccacatcggcaatgccaaggactgggatctttcccgcaagaacagcggcgtaaccttgctgccgccgtactcctactccaagaaggcgtctccgctggtaaccggcgagtaccgcggcaagattgacgcactggccggtgcggttgactttctgcagaagaaccgtgcagactatgtagtcgtagcagacggcgacattgttgccaatgtaccgctcgacgacgttatcgaccgccatatcaagtccggcgcagacctgaccatggtatgcaccaaaaagcagaagaattccccgttcaccacctatgtggagctgaaccgcaagaaggaagccgttgacatccgcgttggagactgcaacgaaggcaagtgcaagcatgcggcactcggcatttacgtcatgagccgccagtaccttatccacatgctgtccgactgcgtaacccataactgcatccactttgagcgcgagttcctcacccgtgccctgatggacggcacggtagccggctacctgttcaacgagtacgccgtcaagatcgaggacaccttcgactactaccgctccaacatggacatgctcgacaaggatgtccgcaacgaggtattcaagcgcacccgtccgatcctgacccgcatcaaggacgaggctccgacctactacggcgatgaagccgacgtagaggactgcctcatcgccgacggctgccgcatcgagggcaaggtaaagaactccgtcctgttccgcgacgttgtgattgaaaagggcgccgaggtcaataactgcatcatcatggaaggcggacgcattctgaccgaggcttcgctccgtcatgtcatcaccgaccgcaatgttattatccgtgatggccgcacgatgatgggacacgaaaattatccgatcaccatcgcaaaaaacgcaaccgtttgatccttttctgttaaatccgcataaacttctgtttagaagttgctatcacagcaaaaacgcattttccgcagcgcaaatgttcgtgaaatattgctatattacattcagacagaaacgagtataataaaattacaacgggtgcggaaacggtcagcgctgtttccgcactctctgttggggaggctcggctttatgaaaatcatgtatgttaccagcgaatgcgctccgttcatcaaaaccggcggattgggcgatgtagcaggttcgctcccgcaggcactcgctgccaagggacatgacgtgcgtgtattctgcccgctgtattctgcgatcgaccagagtatgcgcgaaaagttctattacatcaaaaacgcttacgtccgtctgggctggcgcaaccagtactgcggtatcttccgctatgaggcagacggcgttacctattatttcatcgataatgagtattacttcgcacgcggccagatctacggcgagtacgacgacgcagagcgcttcgcgtactactccaaggcggtactcgaggtactgcccgatctggagtggaagccggatgtgatcaactgcaacgactggcagaccgccctcgttccggtttactacaacctgatgttcgcttcccgtccgttctacgagaacatcaagaccgtgttcactatccacaacatccagtaccagggccgctacggccgtgagattctggagtatgtgctcggcattgacgatgcacacttccgctccggctttatggcgatggacggcgacgtcaacctgatgaaggctgctatcgtagcttccacggctgtcaccacggtttcaccgacctatgccaacgaaattcagaccgaatactacggctaccgtctggattccgtgctgcgcatgaacagctacaagctgcacggcatcctgaacggcatcaacatggatgccttcaatccggagaccgacagcaagatcttcaagaactacggcccgaacaacccgcaggataagctggtcaacaagaccgagcttttgaagctctgcggccttgagggcgatgcaaacacgcctgtcatcggcatcgttacccgctttgttgaccagaagggactcgaccttgtggaagcagtcctgccggatattctggcggatgatgttcgcctgatcgtgctcggcaccggcgactaccgctatgagcagatgttcatcgaggcaaagcgccgctggccggataaggtttccgcgtccatcatgttctccggcgatctggcaaaccgtatttatgcaggcgccgatatgttcctgatgccgtccaagtttgagccgtgcggcctggcacagatgatcgcactgcgctacggcaccattccgatcgtccgcgagaccggcggcctcaaggacaccgttcacgcctttgtcgattatgccggcacgggcaacggcttcacctttgcaagctacaacgcgcacgacatgctgcacgttatccgcgaggcctgcggcgtattccgctttaacaagcctgcgtggagcaagctgattatgcagggtatgcagagcgacttcagctggggcagctctgccgataaatatatcgaggtttacaagaccgcgatgggtcagtaaccgacctgtcagccgatttgagggaatacggtgacggtaaccggtgattccgtaattttcatcccattgaaatctacggcatccttagaggtgctgacgagtgatacggcaagagtgatttgcgagtaaagtttgcgatttggctaggcgcggttccgcagcaatactttgtgtattgcaagggatcgcaacgacgccaaagcgcaaaatttccgcaaagcaccgcagacgtatcgctcggcagtgcctccaaacaactatgtgaggagataagaaagaccatgccaaagacccagtacacaaagaccgctttgaaagaagccattgcaggtaaactgcagcgacattttgcctgcgaggtagaggacgctaccaaggatcaggtatacgaggcttgtgccctcgtagtgcgcgatgcactgaccgagcacatgatcgaaacccagaatgaggtagagcaagacggagagcgtcaggtgcattacctgtgcatggaatttcttgtcggccgcagcctgcgcaacaacgcctacaacctcggtatgctggacgctctgaccgcagccctgaaggacatgggcttcgaaatggcggacatcttcgaggaggaagctgatcccggtctgggcaacggcggtcttggccgtctggctgcctgctacatggacggcatggcgaccgacggcgtacgcggcaccggctactccatccgctacgagcacggcattttcaagcagaagatcgtagaaggccagcaggtcgagctgccagattcctggctgtctaccggcgaggtttggcagattccggcaatggatgagacccgcgaggtcaagatcggcggcacggttgacacctacttcgacgataacggcaagctggttgtcaactaccacgattacacgccggttctggcagttccgtatgatatgccgatctccggctacggcaccaacaacatcgcgcgtctgcgcctgtggaaggcacagagcccgatcgcactggacatgaagctgttctcctccggtgagtatctgaaggcactggagaagcacgcactggcagagaccatctccatggtcctctatccggaggataaccaccgcgagggtcagtccctgcgtctcaagcagcagtatttcctggtttccgcaactctgcaggacatctgtgcaaagcacaaggccaagtacggcacgcttgaaaacttcgcgcacaagcacgtcctgcacatcaacgatacgcacccgactctggttattccggagctgatgcgcatcctgatggacgagaacgacatgagctgggagcaggcctggaacatcaccagccagtctgttgcttacaccaaccacaccgttatgcctgaggctctcgagtgctggccggtatcgctcgttcaggagctgatgccgcgtgttatgcagatcatctacgaaatcaacgagcgcttctgcaaggagctgtggaactacttcccgaacgacttccagaagatctccaagctggctatcgttgccgacgataccgtccgcatggcgcatctggctatcgcaggctcgttctccatcaacggcgtatccgcgctgcactccgagatcctcaaggagcgcgtattcaccgatttctacaagatctactcctccaagttctgcaacgtcaccaacggcattgcacaccgccgctggctgtgcgaggccaacccggagctggcagagctcatcgagagcaagatcggcaccggctaccgcacccatccgtccgagctgcaggttctgaacaactatgcagacgacaaggagctgctcgacaagctgggcgagatcaagcgccacaacaagcagcgtctggcggattatatcaaggcgcacaacggcatcgaagtcaacatggactccatctttgacgtacaggttaagcgtctgcacgagtacaagcgccagatgctcaacattctgcacattatcagcctgtatcacaagctgaaggacaatccggatatggatttcgttccgcgcacctttatcttcggctccaaggccgcaccgggctacgcagtagcgaaaaagaccatccagctgatcaactccatctccaagatgatcgacaacgatccggcagtacgcgacaagctgaaggtcgtattcctcgaggactacaaggtatctctggctgagattatcatgccggccgccgaggtttccgagcagatctccatcgccggcaaggaagcatccggtaccggcaacatgaagttcatgatgaacggtgctctgaccatcggcacgatggacggcgcaaacgttgagatctgcgaggcagtcggcaaggagaacatcttcatcttcggtatggaaacgcccgaggctgaggcactggccgcttccggcagctatgagccgatggtcatctaccagaacgatccggtgatccgccgcgtgctcgatcagatgatccacggcttcggtgacggcgtggactacaccgatattgccaacctgctgctgcacggcggcaacggcggcccggctgaccgctatatgagcctcaaggacttcgcatcctacgcagccgctcaggagcgcgtaagcgaggtttaccgcgatcaggatcagtggaaccgcatggcgctgatcaacattgcaaactccggccgcttcgcagcggaccgctcgattgctgagtatgcacagaatatctggcgcgtaaaaacgaattttgcattctaaggcttcgccttcgatagaaaggacgtaaccgtcctttctatcgagaaacgcccttgccaggcaagcctgtaagggctattgcagagaaatcccccgaaaacttcccggttttcgggggatttctctgtttgttaaaaaagtcaggcacatgtcctgacttttttgtcgcgctacgcgctccattttatatgcgaacatagttcgcaatcttcccattttccattctcttcactctccactctccaatctcaactctgtattcgggtagtaatgcgcaagtatctcggtataatcatatccctgctccgccatatatttcgcaccgtactgcgacagaccaacaccgtgtccgtatccgatggtgtgaaacgtaatactgtcctcggtggttgtgatggtgaaattcgtggactgcaggccaaacagcgcccgcactgcggttccctcgacggtcacgccgccgagcttcacggttttcacaccgccagccgccgagcgcaccgaggacgcaaaccagcggtcgggcgtaccgctcacatccgcttttggcagagtctgcgcgaccttttcgcggaacgcatccgccgttagcgtcacctcgctctcgtatccggcgtactgcgtgccgcccggactgaccacgctttgcagatacggaatatcctcgccccagacatcagcggcagactcggtcttcggaccgctgacgcagtggaacacagccgcaatcggtgcaccgtcgcaggtcaggatctgccctgccgtgtccttgacggccttgcgtatccgcgaatagccggtgctgaacgtcttgaccgcgtccggctgatatgccgcacaatggctgtaatcgtcgcagacatccgcatccggatgctctgcaggccgtcctctcgactgcttatacaccgcgtacgtccgcgctgcgaccgcctgtgcgcggatggcttcaaccggaaaatcgtccgcaatctctgccgccgtcacgccttccacataggtctccagcggcatttcctgcgccttgccgttcaccagaactgtgatggttacgccgtctgttgctgccgctgtgacgctttctgcgggtgcctgcggctccgtcttgtccgtttccgatgggtaaaataccggcagcaaatacagcaccagcaccagtccgacaccggtcagcagcagtctgtgcatggtatctcctccttccctctctaccacagtgtatgatgcagattggaggaatataacacaaaatatagttttccattgacaactcatactttatgttgtattataagggacataaagaatcgaacatttgttcgtatatcgtaaggaggggccgccatgaaattatgtgagatggcgcaggaataccgtgtaaatgtcgctctgctggagctgcgtatcaagcagcttcaggcggcgcagaagcgtgcgcgtcagccggaggtgcgctaccggctcaagcagcgcgcgaaattcctgcagacgctgatcaacgaaagccgccagaccgtattcctgatggagcactaccacgaccacagtgaagaaggtgacgcgcatgcggactgtcgcgctgtctgagcacacagcgacacggctggcctaccggcagtatctcggtctgctcgcggaggacgaccgcggcttccggcaggcattccgcacggccttcttccgggccatgcgcgagcagctgacaccgcggcagtacgaggtgctgtggatgattgaggtggagggattatcctgcaaacagtgcgctgaacggcttgggatcagtccatcggcggtatcgcggcactgttcccgcggcaaaaagcggctgcggacgctgcttgcgtacaatctggagctgagacaccagtatttttcttagctgcaagcgaaaaccggcacatacagaggtttctctccttatgtgccggttttgtttgtggaattttgtcatgcactgacgagtgttgcgcaggtgcgacagaaggtgaattgcccgaagggccagagaaagtgccctggggtatgacctcagcgcaccgtttctaacgatttgcaaatgtttaaccgtaggggcggccattggccgcccacgcagcactctgccatcgcattcattttccattctccattttcaattctccattctgcacacgcccaattcagacaaacagcaaaaaaagagcggtctcccgaccgctctttttattccgaagtatcagcatgcgcccttttccgagcagaatttgacttctttgccctcaaggatcatatttgtggtgcgcacggcgcacattttaccgcacatcgagcaggtatgacgctcggtcggcggaacctgattataggaccgctctgccttttccgggtcgagtgccagtgcgaactgcgcgggccagtccagcttatggcgcgcgtccgccattgcgttatcgcggtcacgcgcaccgggcagaccgagtgcgatatcggcggcgtgggccgcaattttgctggcgacgatgccctcgcggacatcattttcatccggcagacgcaggtgctccgccggtgtaacgtagcacaggaagttcgcgcccgcctgtgcggcaatagcgccgccgatggccgaggtaatatggtcgtaacccggtgcaatatcggtgacgagcggcccgaggacatagaaaggcgctccatggcaaaggcgcttttccatctgcatattggccgcgatctcgttcatcgccatatggccgggaccttcgatcataacctgcacgtccttcgcccacgcacgctgtgcaaggttgcccagctcgatcatctcactgatctgccctgcatcggacgcatcatcaatgcagcccggacgcagtgcgtcgcccagcgaaatggtaacgtcgtagcggcgcagaatgtccagcacctcgtcgtaatactcgaagaacggattctcattgccggtcatcttcatccatgcgaacagcagcgagccgccgcgggagacgatgttcatcctgcggccctcgcgcatgaaggcttcaaccgcacggcggttgatacccgcatgaatggtcatgaagtccacgccctccctggcgtgcgcctcaacgaccttgagaaaatcctgcgctgtgatctcgagcaggtccttttccagatatccgatcgcgtcgtacatcggcacggtgccgatcatcgccggcgacatgtcgatcagctgcttgcggaaggtgttggtcttgccgtagttggatagatccatgatggactctgcgcccatgtcaacggccatgcgcaccttgcgcaactccatctcgtagtccttacagtcacccgaaatgccgagattgacattgatctttacgcgggtgccgtcgccgaccgcctctgcggacaggcttttgtgattgatgttcgccggaatcgcaatcgtaccctttgcgactcgttccatgatgaactcgaccggacggttttcctttttggcgaccgtctcgatctccggcgtgacgataccgcgctttgcggcatccatctgcgttgcataatttctcatggcttactgatactccttcggaataaaatttattgcttccggagtgcggtatgaaaagggaacgccgaggcatgcggtgcgctctgtcctgacgaccccgccgcacttcggcggctgacaagccttgttctaagggggactccgtcccccttagataccgaacaagttcccaaggaaacttgtccggatatccccctctcgtttgcacagcaaacgaggccgcgccgctgcggcgcgggcagtggtaagaaagtcaggtacacgccccgactttcttagggaattttatgcggcacactgcggtgcgcctgttctgcctgtttcgccgaaagcgaaatgcggcagaaatttgttatacatataagtagtcggccattacaggctgcagattatgctctacgattgcgttatacacctcatcgaccgagcggccgtccgagatctcgaactgctcatcgcccttatcctcgccggagtgaccgccgataccgacgtctacgcctgcggaaatcttggtggcggcgatgccgatgatattatcgcggaagcccgcccgctcgcgggtcgagatagtgatggacgcgaacggcatgaagatgcggtaggcacagaccacctgcagcagctgcggctcgtgtacgtccttcggattgatcttatcgttattgatgatcgggcgcaggcgcggacacgagaaagcgatctctgcgtgcggatacttgcgctgcagcagatacgcgtgaagaccggtcgcaaacgcatccttgcggaagtcggacagaccgagcagcgccgcaaagccgacaccgcgcatgccgcccattaaggcacgctcctgtgcgttcaggcgatacgggaaaatgcgcttgtgaccgccgaggtgcagggttttgtacttctggtcgtcataggtctcctgaaatacggtaacgtagtccacaccgcactcatgcagataagcgtactcatccacgttgagcggataaatctcgatgccgatgacacggaaatacttgcgcgccagcttaacggcctcgccgatgtaggataccggcgacatggcacggctctcaccggtcagaatgaggatttcctgcagaccggtctccgcgatggccttcagttcctgttcgatctcgtccatatccagcttggcacggcgaatcttgttatgacagttgaaaccgcagtaaatgcagtaattttcgcagtaattggcgatatacagcggcgtgaacatctgcaccgagttgccgaaatgcttgcgcgtttcggcctgtgcgcgctgcgccatctgctcaaggaacggcagcgccgcgggagacagcagcgccgcgaagtcctccggcgagagaacatccttgcggagcgcacgcagtacgtcagccgccgtataggcatccgcgtcataggcgttcatgcgggaaatgacctcgtcctgcacctcggagccgatgttgtccatacccggctggtactccatgtgattggtttgttcagtgatatattttgcggagatgatctccgttttttcgttttccatgacaaatacctttctgttttcgcgcaaagcgcgcatttaatcgagaactttaatcctgcaggaaaccggtcagcggagaggatgccgaagccgtctcacggacacggcccagccccgcgaggtatgcggtgcggcccgcctcgatggctttcttgaacgcctcagccatcgccggaatatcgcctgcggtggcaatcgcggtgtttgccatgatggctgccgcgcccatctccatcgcctcgcaagcctgcgacggacggccgatgcctgcgtccacgatgatcggcagatcaatttcatcaatcaaaatcttgatgaactcgcgggtagcaagacccttgttcgtaccgatcggagccgccagcggcatgatggaagccgcaccggcattgaccagatcacgcgcaacgttcaaatcggggtacatatacggcataacgataaagccctcgttggcgaggatctcggtcgcgcggatggtctcctgattgtccggcagcaggtacttgctgtcgcgcataatttcgatcttgacgaaatcgccgcagccgcacgcacgcgacagacgcgcaatacgaaccgcctcgtccgcgttgcgggcacccgaggtgttcggcagcagcgttacgccctccggaatatagtcgaggatgttagccgtgccgccctcatttgcgcggcgcagcgccagcgtgatgatctgtgcgcctgcgttctgcacggcagcgttgatcaggtcgagcgaatacttgccggaaccaaggataaagcgggactggaactcgtgtccgccgattacaagtgtatctttcatgtgaaaaactcctttttcttgacccatttaagggaaacgtgtaaactgatagtataaataagaaaggggaacgcaaaagtgaaaaagtttatcgaagaattcaaagccttcgcgctgcgcggcaacgtgatggacatggcgatcggtgttatcatcggcggtgcattcaccagcattgtgacttcactgaccgaaaaccttatcaacccgatcctcggcctgtttggcggcaccgatttaagcggtttcgtgctgaacctcggcggtgtggaactgcgctacggtgcattcatcacctcgatcatcaactttttgatcatggcgttcgtgctgttctgtctgctcaaagcggtcaataagctgactgcgctcggcaaaaagccggaagcacccgcagagccgaccaccaaggtctgcccgttctgctgcagcgagattccgatcaaggctgtcaagtgtgcacactgcggttcggatcagcccaagtgataattacatagccgtgcgaggggcgaaccggtcggttcgccctttttatttgctgttacggctccgtttcgccaatgagcagacgcagcaccatggttccctcgtgtgccgagcagaccgctacgcgcggcgccatcagaccgagaccgtcggctacatcgcttgtaccgtcgccgcagaggtacacatggccgaagcgtttttcggtcttgatcaggttcgccgagccgtagcctgccatgccgctgcccgatacgaccggcttttccggcagtctggtaagcagattctcgagcagcatagccttctgatccggcttgtcgaacgcctccacgaccacatcacagccggagaacagccgctccacgttggacggaacgacccgctcggtgtaggtctcgtaggtaagatagggattgatggcctcaagctgctcaacaagtgcgagcgttttcgggatgccgaggtctttcatcgtgtaatgctgacggttgaggttggtgatgtccaccacatcgaaatccacgaggatgagatgaccgacacccagccgcgccagaaaaatcgcaaggttggatccaagcccgcccagacccgcaatgccgacacacgccttgtccagcttagcctgaatatccgcgccgtggcgttccaccagtgcgtcatgcagttgttctttggttaaaatcatgatttttctcctgtaatcacgcgcagcgtgcatttaatcggaaattgcattgcaatttctatgaaaaccgggagtttgtatctcggttttcataccagtaaaaaatgcgtgtgccgctcgcggcgcgcaaatttctttgggacatatccgcgttttacgcagtatgtccccttcgcaccaagctgtggtttggtgcgaagggtatcagccgccgcccacgaagcatacgacttccagatggtctgcatcggtcagcttctcttccacgaactgcgcgcgcggaatgatggtaccgttcttctcgacagccacacgctgcgggtcgtgacccagctccttcagcagtgacagtacggttccttctgcgggaacagcgcgttcgttaccgtttactttcatgcaaatatcctcttttctgcaagaaaaaatgctccggtctcaccatgcggtaaaaccggagcattaaaatttcaagtatatgcgacagcttccctacgatggtgctaaccaacaggttcaaaaggttaggctctcgccctctcagccgctcatcacggcacccttgcttgcaaatacagtatgcacctcattctcccacttgtcaagcacatttttttcggatataatgcagttatacaatgcaaacattcgttcgaaaggagatgatgaccgatggacagaaccattctgcactgcgactgcaactcgtttttcgcgagtgtggaaacgctgctcgacccgtcgctcgccgagggtccgaccgcggtctgcggtgatccagagagccgccacggcatcattctcgccaagaacgagaaggccaaagccttcggcgtacaaactgccgagaccatctggcaggcgaaacggaaatgcccggatttacggctggtagcaccgcatcggagcgaatatgtgaagttttcgcgcaaatgcaacgagctgtacctgcagtacaccgatcttgtcgatccgttcggcattgacgaatccttccttgatgtcaccggctcgatgcacctgttcggctccggcgagcatattgcggacgagctgcgccgccgcatgcgcgaggaggtcggactgaccatctcggtcggcgtgtcgtttaaccgcgcgttcgccaagctcggcagcgattacaaaaagccggacggcacgacggtcttttcgcgcgaaaatttcaagcagcgcgtgtggaccttgcccgcgaacacactcctgtatgtcggcaaacgcgccagcgaccgactgaaccgactgggcgtgcgcacgatcggcgagcttgccgcctgcgatccggcgtttatccacagcattctgggcaaaaacggcgatcttctgctgcgttacgccagaggcgaggacgatgagccggtgcgctcgttttacgccgaacgcgaggtcaaatcggtcggcaacagcatgacgttcgcgcacaatctgctcggcgcggacgaatgccgcatgggcattacggcgctgtgcgacaatgtcggcagacgtttgcgaaaacgcggcatggtgtgccagaccgtgcagctcggcatccgcgacccggagtttcacaaccgctcacgacaggtaacgcttgagcggccgaccaactccacgcggacgctcatcgatctgtccatgcagctgctgctcgggcactggccgatggacaagccggtgcgcctgctgtcggtcacggcggccaatctgctgccggaaaatcagtcgtgcgagcagctttcgttgtttgatgccgccgaggatatccaaaagcgcgaccgccagcataagctcgaccagacggttgacgcactgcggcagaaattcggtgatcaatccgttgtgttcgcgcattcagtgaagaaaaaggataaaacggataaaacatgaggacatatccatcggatatgtcctcatgttgcgttactgcgtcagccggaaggaaactgcccatctgccgtccatcaggttgcttgcggtgtagagatcaccggtaagtgtacagccggcaacattctcgtatgccatcgggaaaacgtactcggtgacttctgcatccgcgtcagaatcgacgtaggaaacgtcgtaatctcgccaaagctcagtgccgtccgtcatgcggagtaccgcaaaatccgcatggttgtcgcgcgacagcttgccttccgtgcggtatgacaggtgcagtgcaccatcgtgccacgctgccgcagtgagcgtaaaattgccgtcctcgctttgccagagcgtgccctgcggaacaagaaaatcgtagtcgtgtacgtcttcgtacatcgaaatatccgaggcactcagaccgttgatatcgtggttctccgtcggtgcatttttcggcacagaagacaaatccgccgttaccggaacaccttcctgttccactttaccaatcagcagcttgttaaacgaaaactcgaacgcgcctgccggaatatctcctcccaaatcgtcaatttgaagaaaatacgttgccatgtgggtacttgggtcgtagtcaaccgtcgagcaaccgcaggacagcggtgcagctctgccccagcgcggataatccaaatgccagctgtcatacagatccggtgcagcatcgccgaacaggctgcccgtggtgtcggtcagcgacaaatacacctttgccgtgctgccttccacgtccgccgaaacgacctccagcttgacgccccggtcctcgcagacctgcccgaccggctgcaggtactccgccatgccgggcgcgatttggtacagcacccgcagaaccgcctcctgattggcggctacggcggtgctcacgcaggccagtgccgccgcaaccgcaaggatgatcttgagcggttttcgcgctctgtgcggcctgccgctctccattttggcgattgtctgctgcaccagtgtgtcgctcggcgtaatattctcattcatgctgcggtactgcttgtgaaaatccatcatccagctctcctttcatcaattcgcgcagctgtgtccgtgcgcgtgtcagccgtgtacgtatcgcggacggtttttccccgctcatgcgcgcaatctcctctgcggtgtaaccctcgtagtagaataaatgcactgccgcgcggtacttaggcgtcagccgccgcagagcttcatccagcgcgctgtcctccggctcgggaaacggaatgcggtcatcgagcggtgtgtcgtgccgccgccatgccatgcgccagtggcttttcaggcagttgagcgtcacccgcagcagccatgccttttcgtgctccacactgtcgaaaaccggtcgtttacgcacggtctggagaaagacctcctgaaaaatatcgtccgcatcgtgacggctgcgcgtctgtgcatacgccaatcggtataccatgtcaccgtagacgctgacgagttgttcgggtgtttttgcggtcatgctccatcctcctttcaccggtaatacgaaataaaaacccgaagtgctacaaactttttgctaaaaattcgcagtccttcggatttctataattgagaattgaaaatggagaatggagaattgtggtatcgtgctttgcacgatgattcaataacgcgtttcacgcgtatattatcgcgttcatggaaattccatattcattttccattctcaattctccattttccattaactccacgcttgcttgagcagctttgccgcctcgtcgatctgctgttcggtcagaccggcatagccgagcacgagtgttgctcgcggcggcttgaccggcggcgtatagtacgccgaaagcgggtaaacgcgcacaccggacgcctttgcgcgctcaataagttcgtgctcgagcatgccgttgcgcatgtgcagcagcaggtgcagaccggcttccgagcgcgagacctcatgcggcaggtcggccagctcgcggtcaagcgcagccatgagcgcgtcgcggcgtgcctgatagaccttgcggctgcggctgatgtgccgctcgaagccgccggtgtgcatgaaggccgccagcgtgtgctggtcaaagctcggcacggtagacgagtaccgcgaaaaccgttcgcgatagcgcgccatcagcgcattcggcagcaccagatagccgatgcgcagtccgggggcaaggcttttcgcaaaggtgttgacgtacacgacacggcctgtccgatccagctcgcctaacgccggaatcgggcgggaggcgtagcggaattcgctgtcgtaatcatcctcgatgatgtagcggtcgggcgcttccgacgcccagcggaggatttccagtcggcgggcagccgtcataaccgtgcccagcgggaaatggtgcgacggcgtaaggtataccaccgatgcgtcactcgcggccagcgcgtcagcacgcagaccgtgcttgtccagcggtgtcggacgcacggtcacaccgttcactgcgaaaatctggtacagcttgcggtagccggggttctcgagcgcgtacacgcggtcgcggccgagcagctgaatgacaaggtgcatcagatactccgagcctgcgccgatgaggatgttgtccggtgagacattgatgccgcggaagtcgtgcaggtagcgcacgatctcctctcgaagttccgccgcgccgcatggatcggtcgcacggagcagcgcactcgagtattcactcagcacactgcgcgacagccgcgcccatgtggagaacggaaagcagccgttatcgacaaaatctgtgcgaaaatcgtagggataggtctcctcggagtcggaaatcggcggcaaaggcggtgcaaatggctcctgcggctcggaaaccggcacggcaagctgctcctgcacaaagtagccgcgccttggcgcagaggcgatgtagccttcggcagcaagctgaccgtaagcggtttccacggtgatctggctgacgcgcagattggccgccagctggcgtttgctcggcaggcgcgtgccgccgggcaaggcgccggacatgatatccgcgcgaacagcgtggtagagctgctcgtagagcggctgttggtcgtgcggtttgagatggtaagtcagcatggccggaggctcctttctttgcgtcttttgcaaaatctgtgctgattttatgagttatcgcttgcgaagcgaacgaaatctgcgctgacgccgcgcgggcgcacaaggtgaattgcccgaagggcaagagagagtcccctgggggataacagtgtcgcgcaaactttttgcacgttgttacggacagttcctacggtgaaatgtaaatctatatctgcgaattgtatccgcaggtgctgtctacaatctccagactaacgattcgtgcggcactgttatcccccaggggactctctcttgcccttcgggcaattcaccttgtgccgcacccagcgtagagtcgccgatctgtgtagcagtcagaaaacagcttgagcatctgcggttgagaaatgggcggccattggccgcccctacggaagatgaacagtacggccgttcccccatagtctcagttctctgatagccgccgtgctaagcggaaacggggagattcacaagaggggtggaaaccttggtgtccatccctcttgtgcccccgccgggtaggcgttcccctcgcctcgaaggcgaaaaacctacgttaaataagcgccatcgaacgcagaatgaacagcgtcaatgtcagcgtaaccgcactcagcgccgtgctgagcacaatgatcgacgatgacaaaacatgatcgccgcccatatttttcgccataacataaccggaggctgtgctcggcgcaccgcacaggatgacgatagccaccagtgtctgctcgcggaagccgagcgccacgcccatcggcagaaagatagcactcagcagcaccagcttgataaacacggctgcacaggtcgggccgagctttttgatggcctttgcgccctcaaaacccgcgccgatactcagcagcgccataggcgttgcgcagttgcccagcattgacaaacccttgtccagcatcggcggaaagtcgattgccagtagcgagaacggcagacccgcgaaaatacccagtatgatcgggttggtgatgatgccgcgcagcgttttgccgaccaggccgcggtggtccgcctgctgtgcgtccggcgcggtgacagtcagcaccagcaccgaaaagatgttgtacagcggcacgcttgccacgatcatcagcggcacaagaccggcattgccgtacagattctgcacaaaggccacacccagtatcgcctgcgagccgcggaaagcgccctgtgtgaacgcgcccaccatactcttatctttaagaaagagggacgcgccgatccagacggcaaaaaaatacaccgttgtcgcacccgcacagaaaaagaaaaacacggggtcgaactgctcggtgatgcgtccctgtgcaatatcgcggaacagcaggatcggcagcagcaccttgaacgacagacggtcaatgtcggtcagcgtctgcttggtgaaaaagtttttgctgcgcagccagcggccaagcacgatgatcgcaaaaatcggcacggtggcattcagacagaatatcagattatccattggtttctccctccacggctgcttcctcgtggcggaagaagtcctgcagtttctctaggctctgcaccagaagcgcggtctgctctggcgagagcgtgtccaccaaagacgcgatcatacgctcgtgaaagtccttgtggtactcgtaggcggccctgcccttgtcggtgagcatgatattgacaacgcggcggtcctcctggctgcgcacacggcgcaccagtcccttggcgaccagcttgtcgcacgcaaccgtcagcgtagccagtgttacgccgattgacctggcaacctcgctcatacgcacaggttccctgtcaccgatcttctcgatgatatggatttcggtgatggacaccgcgctgcccagtccgcccgccatggcgcgttcttcgattttattgatccggccgaacacatcgaccagaaaggaattgagctgctctgcgtcttccatgttcgcgctgtccctccgttagttcgttaatctaactaaatattagcataaaattgtcgagcttgcaacaaaaaaggcgcaatcgtaagattgtgccttcggatatatggagttttcgctaaagcaggtggaatggttgccaacctttggctgggaggtccaaaaggatagacaccaaggtttctatcctcttgggactccagtttcctttatttcttagtctggagaaaatcggagaacggcgaccgcttcgaaaaggagaacggcagtcgggttaccgtggcgtatctttctccgccttttcgcagttcacagacagcgtactgctacacatgcgttttcatctccgctgagaattatgcctgtcggccaactcctgcctcctcactcctaacttacggaatctcttcgccctttgcaaaactttcaatctatgtttcacgccatcccagctgtgcatttgtgcattttgtataaacttacacattgcacagtgccgctatcgcggccctcaggaaggcgctcagcacggcaagcgtaatacacaggaaatacggcatcctgcacgttcgaagcgaataccgtccggtggcttcaccgccctgccagaccatagagcatgcggcaagcagcgcggagacgctcagcacggcgggtacgccggctgctccgatgataagggcgtttccttctcccacgctgaccgcgacggtcatggcaagcacgaagccgcgtgctgcggcaaccgcactcagcagcagctctctcgggcgcagaaaggcgcacacgagcggcagcagcacccagatgagcgcgcacagcgtgctctgcaccacatgcgcgggcaattcagccagcagaccggaaagcactgccgcgccgtccccttcgccggcccgcagaccggtcagaccgcccgccgctgcaccgcacaggaacatcgcacacaggaacaggaacaccggtgtccgcaccaaatcgtcaaaaaaaccgagaatatgctgtttgttcatacgtcttcccccttggaaaagtcatagaacagcatattcccggttttatctttttagaacaacagacggacttagccttcctcgttgatcatctcgcacatcgcgtccaccatgtccttgcagggctggcgcaggaacgggcgtgcctttttgttgatctcgtaggttgcatacagcttgccttcctcgtcacggtgcagcacggccgcgatcaactcggttgcagcggcgatgcggtcagtcaggtacgcaagatccaccttttcgctgtcgcacacggaaactaccacgcgcttttgcgaactgctggaaatcttggcaagctcggtcggcatttcacgcttggaagcggtgagcagcacaatctcgctcttgatcatggcagcaagttcgtcctcgcagatacgaacctcgtcgtagccctctgcagccttgcaggccgccgcattcttcgcggacaggaacagattgcgctgcggtacgacctccttctccaggatggcgcggatcagcttctgaagatattcaccttcaccaagcacggaaaccagtacattctgcggcataatatcatctccttcacagggcagtacaaatacaagagcaattatacgcacaaacagtccgtttcgcaacggattttacagattctttttacaattcatcacttcgactgatttgcacaaattttatccattgcctttagataaattgcacattccagacgcttgcgctccatctcgcagccgaggtcgtaggagtcgttcatgtcgtggttcatgttgtagtttgctgccgagcagccgcccgagcagtagaactttgcccagcacttctggcacttcggacgagaatagatgttcatgccggcaaacttctgcgcgatgtccatattgaaggactggtcgagcacactgccctgcttgaactcatccttgccgacaaactgatggcagggatagatgtcgccatccggcgttacggccacatactcgtagcccgcaccgcagccgcgcagacgcttgacaacacacgggccctgatccagatcgaccatgaagtggaagaacgtgaacggcttgccctccttcttgcgctcgagcatgatgtcggtcaggcggtcgtactcggcctcgatcttgggcagatcgtcctcggtcaagtcgtatccgcagcccgggtctgccgttaccggctcgacggacaggcggtcaaagcctgcatccgcgatgctcagaacgtcctcggcaaagtcgaggttgtgcgaggtgaacgtgccgcgcgcgtagtaatcgaggttcgggtcgcgctcgtccaccagcgccttgaacttgggcacgatggtgtcatagctgcccgtaccggctaccgtcttgcggaactcgtcgttgacctcacggcggccgtcgagcgacagcacgcagttgtccatgttctcattgatatacttgcgcttgtcctcatcgagcagcagaccgttggtggtgatggtgaagcggaacttcttgttatacttctcctccaggctgcgggcataatcgaccgtctgggtaacggtatcccacgccatgagcggctcgccaccgaagaaatcgacctcgatgttgtgacgcacgccggaacgcgcgataacaaagtcgatggccttcttggcgatctcgggcggcatgatcttgcggccctgaccaaagtcgccggtggatgcaaagcagtacttgcagcgcaggttgcagtcgtgcgctacatgcaggcacagagccttgaccggtgcattcaccggaatgtagcggcttacgtcgatgtagtcatcctgcgcgaacagctgaccggcctttttcagctcgtacagctcgtcatatgcctcgcggatctcgtccgcggtgtagtccggcagggcgtcaatgatgctctgcggacaggtatcacccatgttttcatccagcagtccggacactgcatagctgatatcatcgagcagatgtaccgcgcccgaattgacatcgagcacgaaattcagcccttttttctgataacgatgaatcatttattttcctccgatatacaggaacaaggcgcacccgcaggcgcgccttgcatattccttttaagcgtgattactttgcgtgctcgcacttctggtttgccacggtgcaagaggtcttgcatgcggactggcaggaagtctggcactcgccgcagccgccgtgtgctgcagtctgcttcagggttgcagaagtcagggtagaaatatgcttcatttgatttccctcctattttttgatgtggctgtaacgcttctttttccgcatattggcaccggcgtaaccgcccagtgccgaggcgatcaacgagcagagcaggctgatcaccgtgcgtacaaaatgaatggattgaccgagcggcagcaccgcaacgatcagcaggatcagaaaaaccgcaaaacctgcgccgagcgaccagtaaaactgtttttcgcctgcgcgctttgcagcgaccaatgcagcaagcgcactgccgagtgcaaggaacaccagcgcacaaggcgctattgcaccctctgccaatgtgccgcggtgaacgagcaccgcaccgagcagcatcagcagcagagtaccgagcaatccggcaagcaccgacggtaaaaggataccgaccggtgactgaccctcattggtttttctcatcatttcatagcctcccgccgaattttatttatatgtcatgctattcggcaagaaatggggttattactttgcgtccttctttgcttccttgggcgcctcgaccgtctcggtcgccggagcctccttaccgcggattgcccagcggtaaatcttgagcttcgtgcggtcgctcgaagactcgatgaccagaacgtcgtccttgatgctgactacgcggccgataaaaccaccgatggtggaaatctcatcaccgatctcgatggagttacgcatatcgcgctcctgcttgtcgcgcttgcgctgaggacggatcaggaaaaagtagaatacgacgatcagaactacaaacggcaaaaactgcgcgatgatcgcgccataatccgacagagccggcattttgtccaatgccataaccatggttacacctccctatgcaatttgctgtaaatactcactatattatactggatattctgtcaaattacaagccttaatttgtgataacgcgacataattagcgttgtggtgatacgcaatctatccgccgcataaaatagcagtatcttatcgaaatgaggtgctgaccatgcttttccctgctttatttgcgctcggcggtgcatttttcttctttgtgctgcgtgtacagggcgcggacggatcgtttcccaagccgctcacgcccgatgaggaggcggttctgctacgccgcatgcagcaggacggggacgccgaggcacgggaaaagctgatcgagcacaatctcagactggtagcgcatatcgtaaaaaagtattacgctgtaagtacggagcaggacgatctgctgtccatcggcacgatcggactcatcaaggcggtgaacacctttaaggcggataagaatatccggctggcgacatacgcctccaagtgcatccagaacgagctgctgatgtatttccggcagaagcgcaagagtgcgggcgagctttcgctctcggacacgctcgaatcggacggcgacggcaatgcgcttgccctgcaggatatcatctgctgcgaggacagcggtctcactgccgtcgaggagcaggaccggtaccatgccatgcaccgcgcgctggcaggctgtctctctccgcgtgaacgcgagatcatccgcctgcggtacggcatcggtctggcatctcccctgccgcagcgtgagattgccgcgcggctgggtatttcgcgcagctatgtttcgcgcattgaaaagcgtgcgctcgaaaagctgcgggaggctctcgaacgcgagggacggccgccgtaaaagcgacggttgtccccttccgaaaaaaattttaattttttttgaaaaaagggttgacgaatcccggattctgatatatactaaacaagtcgtcagcgatgagtcatcaaaacgacagcaaaacttaacaaatagccgaattgtgtaaaggtagcacgacagactctgactctgtttgtgagggttcgaatccttcttcggctgccactctaaaaccgtgttttcgatgaaaacacggttttttcataactttttgacggactttagatttccaagttttggatgtctgccaatcgtctgtcaaaaagtcttgaaacgtcaaaccgcattgctgcttcccaaaagattcgacatagtttctgccattgtttttttcgattctaccaatacatgaccgtaggtatccgccgttaccacatagctgtgatggcccagccactcctgcacctgcttgagcgttgccccattttcgagcagcagcgtagcacacgaatgacgcaagtcatggaagcggattcgacgtaaattgttcttcgcaagcaagtctgcaaagtagcgcgaaatatatttcgggttgataatatctcccatctgatctacgcaaacatatccgtcccacttccgatgataactttcgccgcccatcatcttctgctccagctgctttttacgaagctgtttcagataccgtgccaacggctccggcataggcaacgtacgatagctcatctccgttttggtttcgccgtagtacaagtccttatagagatcatgcgctttcagcgaaccgcaaatggaaaccgtattcttctcgaagtctacatctttccagcgtaagccgcacgcttcaccctgtcgcactcccagatagcctgctaaaagaattactgtttcaaaccgcgtacccttagagcactcaaacagtttctgcaattcttccggcgtgtagtaactgccgcggaacttctttactttcggcagatcaaccctgtctgcgggattggtcggaatcatatccagctttaccgcacgctgcagcgcctttctgatgtttgcatggtaacggagcaccgttttcgcactcaccttatcgttcttcatcttgagcttgtagaacttatcaatgtgatatgctttcaggtcgcaaaggcgaaggccctgtgccgcaaaccatgggcaaatgcgattgtgaatctgacggtaatactcctcgtaggttgattccgaaatgctgaattttacatcttccagccactgcttcatgtaatcagaaaacagtacatcggtatatccgtccgaaaccttgctctccagctctgccatgaacgcatcggccatggcctgtgccttgcgcttatttcccttgacaggcagcccggtcgccttgcttttgcgaaaacgcttgccatttacagtccaagaaatcgaaatctgatattttccgtgtttttcatatatcgtagcgttcatattcgtcatacattatcctcctttgtcggaacgctactgttcgacacgttaccattattatatagcgctctgtttaggtatgcaacaacagattgtttgtaaattctaatggatttcccaatacaaaaatgttggatttcgccgtcttgaatcagcttatatgcggtgctcttaccaatgcgcaaagccgtttgcaaatcctttacggtcaaaatatccggcaatgaactgaacaccaaatctggtttgtttttatttctatccatacgcattttattcctttagaaaacccgcctgctgcaaaacaggcgggttttctcattctactctcaaatccaatactcattgcggtcgctgtccatgatgaaatcatgttcgtgcgaaacctcggtcacaacagacgagggcgcatccgcccatgtgcggagattgccgctgtaaccggaaacatccggcgagatgtcgcggccggtaatctggcagattgcctttgcaaaggtcagacgggatacatcaccactcagcccaatgtttgttttcgtcgcgtaagccaccagcgagttaagctgaccggaggttgcccagatacgcagatagccgttctttgagatcgtatagttaatctcgtaatcgtcaccctcgtccatgcgagtggtatcaaatgcagatgcaggcagaacgccgatggaaacgaaatactttgcttcttccggaatatcgtactggtatttcggaacggtagctgtgccgcgcggcagccatgtgttgccgccgttagcaatcagacgatatacaaccgtgcaggcttcctgcagggacacacgatcattcgggcgccacagaccgtccgcatagccaccgaacagctgatagtgaatatccgtcagtaccggcgtaccggatgaaccagacgaaaccacttcaatctccggcgaacgccctgcagcggagccgttgtcacccgtggccgcggcaaggttcgtgtacgtcttgccgccagcgtcagtcttaaactccaccgtgattttcacaacatgcttttcgttcggaccaatgtcaccgagctccagagtgaacactttgttccggaaactccatttgctgttcagaacgccgtccacatagacgttgttcttcaaaaccggcgttaccagcgtggtgtccagcgtatctttgaggataacccgtttccacatctggttggaatcattgccaaccgtgatggtaaatgtagcacgcttgcggtctgccgaaacaccggaacccacgttcaccacggttttgtcaacttctttggtgacataaaatgctgtggtatcgtccggctgttctaccgtgtctggaatcgtcacgcccttatctgttgctgtgccgtgtccattatcgccatcgagcgaagccgtgttggtaatcgttgtacctgccgcactttcaagcacctgcacgtcaaaagtaatttcagccgattcacccggttccaaatcgcctacgagtacggacagcgcgttgccgctgagattgtaaagtgcaaactcattgttgagatacacgccgcccaccagcttcacgccagtcgggagcgtatcggtcagtacgacattcttccatgcagcagttgccttattgccgttctttgcggtaatggtgtaggtgaaagtatcgcctacattggcagtggtgacgctggcagtcttgttgacaatcggagcagcttcgccctggtcaatctgtacaccgccgtccggcatgggtgtttccttgccgttatcatcgaggatagcggtattaacaatgaacttgccctgcgaaccatcatcaacagttacatcaaagctaagaacggtctgtgcgcctgctgcgatagcatccggcgtgaaggtgatcgtcttggtatctgcgttgtaggagtagtttaccgttgcagaaccgttctcctgcacattgcccgcaaaggttacgccatccgggatagtatcggttacggtcatgttctcccaatcagcggtagctgctgcgccgttttcaaggcgaatggagtaagtgatcgtatcgccaactgctgcggtggtcttgtttgcggtcttgttgcccgcatgaccatctgccgtaccatcctcaatatccacaccgttatccgtaccgctcttgtccggcgtattgctgccgctgacgagggcggtattttcaatgtgcataccgtaagcgtcgctgttgacaatcacatcaaaacaaatcgccttggtctggttcggcgcgatctcaccgagcgatacggtcagggtcttgccggtattgtcatactgatattctgtggagtagccgtctacggtcacattgccgcggaaagtcagtccgttcgggatggtgtcggtcataaccgcgtcacggatattcacatctgcaccggtcgcattggcagcgtttacggtgtaggtgatcgtatcgccaaccttggcggtggttttgtctgcggacttggaaacggtcagcagcgcgtcaccgtccgcgattgctacgccatcgtccttgtcctgcaccgggtctgcattgtcagaggtcagcgttgcaaggttctgaatggtggtgttgtaagcggattcgttgacagtcacggtgaagccgataacctgctttgcgtccggctcaatcgtgccgacattgacggtcagcaggcgggtattctcatcgtaggagtaatcgttcgtgttcttaccgttcagcgtgacagaaccgtattcaaaggtcagtccagccggaagaacatcggtgataacgccgttctcaaccggaacagttgcggtatcatcgttctttacggtcagcgtgtacgcgatcttatcgcccacgcgggcagaggacttgtttgcagtcttgtcgatctgcggctttgccttgccgtcaccaacggttacgccgttgtccttgccgctggtgtccggtgcattgtcggacttcatcacagcggtattgtagatggtctttccgtatgcagcggtattgactactgcaacgaaagttaccgccgcgcttttctcaataccgagatcaccgaccttgacggtcagaacgcgggacgcttcatcgtagctgtaatcgttggtcagcttgccgttcagcgtaaccgagccgtactgaatatccagtccgttcggaatggtatcggtcagcacagcatccttgatcgctacgcttgcgaactcgccgtttgccagcttgatggtgtaagttaccttatcgccaacattggcagcggacttgtccgcagtcttggtcacatacggcgcggtatcgcctttcttgacatacacgccatcgtccttatcctcgtaagagttggttttcttgccgtcagtggcggtcacataaccgttcgtacccttggcaacagcggtgttgtaaatcgtctgattgtacatatcgccgttaatctttgccttgaaagtggcaatcacggtcttgccagcggcaatatcaccgaggtttacggtcagcgtgccgttcttgacggtgtgggtagccgctacattgttcacatacacgctaccctcaacgaaagtcagaccggacggaatgttgtcagtcagaacaacgcttttccatgcggaacttgctttcttatcgttcgccagcttgatcgtgtaggtgatctcgtcacctaccttagcatccttgacgcttgccgtcttttcgatgtacgggagcgcatcaccggtgctgtacttataagtgatcgtgcggatatagccgcgatactcatacgccggaatggacttgggcgcggattctgccttgcccgccgtagtgacagactttgcaatctccttgccgctcatgtctacgaatttctcaacgatgatattgtacttgccatcattgtacttcgcgtcatgccattcctcggcggtatgggataccgtagcttccatgaggtctgtatagccccagaacgattctgcaagatcgttgtacggatttcgcacattcagtgcctttagcttttcgcgggtaacagtgcggttgatcatgctgtttaccagcgttacagtttcggttcgggtgatctccttgtcgggacggaaagtgccgtccggatagccctgaatccagcctgcttcactggcagcgttgatatagctgtatgcccagtgacccttttctacatcagagaaaaccttgccgctggtgtatttgaggttctggaaacgagccgccagcgcagcgaactcggcacggctgatcggcgcgttcggcacgaaagtgtccttggacttaccctccagcagaccgatattgtacagcgtttcgaccggctcatagaaccagttctttgcgcttacatccttgaaagtgccgtttgacatacgccgcgtaaagctgggataatcaccgtcatacaggcggtagaagatcatagcagcttcggcgcgggtcagatcatcgttcgggtgtacgcccttgtcgggataaccgatgatataggtcaagtccttatgcgaatacacatactcaacactttcggtataatccgcgtaggtgtagtttgtgattgtctgcggggacttttcctcgtgtgtgacgctgtatgtctgctttgggacaatctccttgccgttttctgcgtcaagatattttgccgtcaccgaggacagcgtgcttgcagacttcgtgctgacggcaaacgaacttgggataatcgttgccgccatcgccagcgacagtcctgctgaggtgattcgctttataatcgacattatttcactccatttccattaacctcaactgccccggcagcacaccatcctgcagccaccagtgcagtacttcttccccgctctgccagacagcaggcaggtttctgcggcggcgttccgtcagcatatgttcaaatgcgtgcaggtacgcccgctcataggttggataccgaccaaactcaaactgccgtccggcacgacctgccaacggacagccaatgcaaccgacccgatgaaaaccgcgctcgtacagcaaattgaccgggatatgctcggaacgaatgtagtcccacacttctctgtccgtccagtccacgattggattgcaaatgcgctttgcctgcaagcggcagttctcgaacagccgccgtgtatcgtcgttatcgttgctgatcgtgattctgcggcttatgtctgcggattgtttttcgtaaatgccgcggttcttgcggcgcttggcactttcggcccagcgaacgcctgttgttatcatgcggcccttgccgccctgctctttgagcactgaacagcagtatcgcacaacgcgcgttggcggcatgagtttttgcggtatcaggctccacattgtcacgcgagcacccttgaacattggcaggttgacggtacacttgatgccctcgttttccagccggcggaaagtttcgcgcacatggtagacggtttcgggcgcgtctaccgaggtatgattatgctgtacctcgtaccggataccggccgcccgcgccagcgcaaggcaaacatcgctgtctttgccgcctgaagtggttataacgagcggtgcatggtagtaggtttcgctcatttccgcagccagccgcagacgagcgattgcctgctgttccttattcattgcgccccatgagtttgaagtaggctttgggacgtttcggcagttccgtccagaaaatacagcggccgtacagatcgtgaacgaaactctcacggcctaagtaaagctgtacgtccattttgccgttcggatacaggcacagaacccgatgaccgcgctccggcagtatcttatttgcgtttttccattccatagataacctccaaaagcaaaaccggaggaatccatgcgattcttccggtttgtgattattctgttgtccggatttttacactatcatatatatcatcacctcgcatttctctgtcagcctattcgtcctcacccccggctgccgggaaacatcaggcggccggcggcgtaccgacctcacaggcattgcacctatcttgttgtccgatctcatggcctgtgacgctttcaacgctcgggcggtgactgattgggagtatcattatcatctatgcaggtcgtcgccttgtcgggagccacccgacagttcgcggctttgcgccgcagctctccgcacagaatttgtacctgatgtttgatgttcagttgccaaggagcagtgagagaatatttatccccctcactgtacatcccgaaaaaaacggtcagtggaaaccacttttttagttttttgaaaaatattttttcaaatcacacaaaatgcaatttcttcgcttcctcaccatcgtatgtgaaataccaatctgctgtgcatatgctcgtacagaaagcccctgatagaacagtgcatctatcaactgacggtctgaatcctccaaattttctaacgctttggacaatttttcaaatgtgttatcttctttctgggcaatgtagcagtcctctgcactgggaacaacttctgccatcaaattttcaatatgtatatgatcttcttcaaatcgttcccacgacagttcactatccgccaacagtgtttcttctgcataccgctcccgtctgtccatttgcgaatatgccgcaaacacttcgtccgaaacctctacatcctgtccgaatacggtgataatgtttgcaattacgttgccgttctcatctttaacccgcttatagttgcggtctttctgccattttttcattttaatctccaatctcaaagtttttgtttgagattggagattatggatagcgggcaacacaggcttgccaacagtctaaaaaagagcgaactggcccttgttttttgcttttaggacaaaaaaacaaagtccttcgtatagcaaatttgccatatgaaagactatgtttgaatctatttgatttgccaaggaacaatatgagtgtttaacctatcttagaaaacatattccaacataagctatcaaagaatctataatcaagcaacacatcgttcctacttggtaactattcgttcctactttgcatatagaatatacaaattttttgttataataaaaaagccgataccacatacggtatcggcaaacacatgatatttaattacgcagatcatcaatcaatgccataatatgagaaatctgcgttgaggtcaaacctgttacgtcaaccaaacgaactccagtcacaggcttttcctctcgtcccaaaagataatctgtgctaactctaaaaaaatctgcaattttttcaagcatatcaactgaaggaacgatattatcattttcccagttgctaatgctttgcttagtagttcctaatttgtctgcaagctgtacctgattcaatccttgcgtttgacgtaggtattttatccgttctggaaacatcattcgttcacttcctttgaataagattatgaacgaaatagcgcctatatattaaatactagtattgcaatatttgattttctggaatatactgtgtttataatatattttatgatatagttattccaaaattacttttagcttggaggagtgactatgcgtattatactttgcgatgatgatacacaattcatgcagtcattttcaaaacaattattttccattcttcaaaaacacggtgttatccccaaagtcattccgacacatactggtcttgatgcattacgagaaatcactcatcagccaaccgacgttttattcttagatattgatatgccacagcaagatggtttttcagtagcaactgaattaactgccatggaaaacaagccgttaatcatcttcctatccagcttagatcatttagtatatcaatctttcgctttccaaccattttggtttctccgaaaatcgcatttagaggatttacccaccgtaatcgaaaaactattacatcttttatcgtctcaacagatacaatataccatcaatgttaatggcaataatatctctatttcactttcagatatatcatattttgaaagtgatggacactatatcattgcacatatgaacgaaaaaactattcgtttcaaatctcggatgagcgatatagaaaacgaactgaagccatattcctttatacggtgtcatataggcttcttagtaaattgccgttttatcaaaatatgcagccgcacaagtattactttaataactggtcaagttattcctatcagccgtgctaaagccgaagaaacacaaactatttttatgaaatatatgaggagtttacgaccatgaacttttattttgaaatggcaattaacattttggaagtaactcttattttgagtttcttagttcaatattttggataccgaataaaatatcctgccaaatacatatggactataatcatcggacttgtatcattctgtaatattgcttttttctcatggaacaatctatatgaaagctatgcaagttcattgcaaatactgattaacatcatattctgttgtgttttgttatgcggtccactactccaaaaaatatttgtatctgcatttactatgggacttgtagcaattattgcaacttttacaacccttttgattgcaaagttatctgaaagcgatgttacttttttactaagccaatttagtggaatacgtattacctctatcttacttaccaaattattgttttttataatcacaagaattattctgcgcgtaaaggaaactggtcgaatcaaatggctcgattttattccgcttgtggtaatacctgcattatctattatcacaattactctggtaatgtatgccgctatacaagaaccacatatccaaaatatcgtattctatgcggtatgtatcatattagctcttaatatcttgatttatttcctatttgttcgattgggccaagtaagtaaaatacaaaccgagttggctcttatcagtctgcaaaacgaatgtttacaagagaattccaaggatatcgaaaatatgtatgagactgtgcgcgctctacgacacgatcttaaaaatcacctactctgcatttcctcaatggcaaatgaaaaagatatacaaggtattcagcaatacacacaacagttactacaacaacaaaatgctgtcagcaagctaattaccttttcaggcaacacagcgctggatgcgattgtaaatagcaaaagtaccactgctgaacatgtaggtgtacaactccgcgcaattattacaactccattatctgatatttcaccagaagatattaccatcatactcggcaatgctttagataatgcaatccgtgcagccaaagatagtattggaaaaacagtcgacctgtacattcaaccacaaggtgcatataattctattgtcattatcaacgatattgcgcgttctgtcttatccgataatcctacattgaccacaaccaaagttaaatgttcacaacatggcttcggcataaaaaatatacgtcaagcagtcgaacgtaatcaaggtatgttagaattcttcgagcagaacaatcgttttgaatgtgatattttattgctcaatatacaaagtaggaacgaatagttaccaagtaggaataacctattgcaatttagttcaaaagcagttatcttacagatagatcacagcaacaacgaggtgttgcaagaatgaatttatctgctaaaataactgctttttttcttgcacagaatattattcctgcgcaagaacgtgaaatatatgaatatggattcgctttgctaattgccgattttatcaatttttttgcaatattcatagttggcatcttatgtcaacagacttgggaaaccatattatatataatcatctttgtagggctccgcagtgtgtgcggcggttatcatgccaaaacgcatttgaaatgccatatctgcactattggagtgtacattgtatttttagtattactacatatgcttagaaatagatgtacggcactcctgtggggagattgtatcgctactattcccattattctatttgctcctattgcacatgcaaacaaaccgctttccaaccgagtataccaatggaatcgaacagtttcaatcattctaactttaggattgattataagcgctttcttcttaaatctttataaccatacagaaagcgcagtaatttccttgacgctttggattgtgtctttgagcatgattccagcgatagatattcattcacccaatttaaggaggcataagacatgaacaaatggatttatcgagtatgcaccaaactggcagcttgtgcatttctcgccgcaatcgtttcggttggcacagcatcatgtaatggtatgtatcagcccgaaattccttctcagctgaaataatcttctgaactacagttttctgcatattctcacgaacatgaaaacgacagttctgcccccaacttattccacaacttattttttatcatcatttttatatcacgaaaggaatgaatccaatgcagaagttcagttaatcaattaatgagttttcatccaagccgaactgctaacatggaggtgaacagcagtatgactatcaaaaagtttcttgcaggcagtctttcttccgtaatggttctctcgtgtctcaacgtaggtgtcgctgcactggaacccaacgcactcgatgatgccacgatcaatcagttgaaggcaaccgcacaaaacgagattgagcatttttttccgtgagagcgatgaagacctctattcgcttgttggctttcgtttcgatgacggtgaagtaacccagtccgacggctcggttcagtacgaaaccacggtcactgtcagcgaacgccttaaagcgcagagcgttgaagaaatgccgtacatcgctggctatctggatgaactcggcgcttcttcgtatgccacaatggccgcatccgataagacggagttggcaaaatccactttcggcttagatcaggatactgccttgacggcggcccagcagaatgttgttgacacatttgttcagtcgatggacacaactgttgagatgttcgacgaatacattggcgaaaccagcgatttcacctatcatatcaaggtttctgcacctgttgccgagccggacaacattacactgaccggccttgacgagttcgacaacgatgtcaatatcaatgagtacgaactgcggtcgtatgacgaaatttaccgcaatggtgcagaagatgcgcaggctgctgttcagagcatgatgatttcccccgcttgggttgctactaagatcaataactacaacagctataaccgcattgccgctcgcgattacgcatacaagtattggtcgtcttacaatccggcatataccagctataagggcaacggcggtgactgcgctaatttcgtttctcagtgtatccatgctggtggtattcccaccgatgcaacttggaaagccgattctgtttcgtggattcgtgcatccgcagtaccctcgtatatggtaaacaagggttatgcaacaaaaaccagctacaccaatgctacggctggcagctttgcctatacttcgagcggtgcgggtcatattgtgttagtaagcattaatgatggtgctaaaatcgcgtacacagcacacaccaccgatcgaaaagacgctgcgttctcctcggcagatttgaacggcaattacagcttctatgtaatcaaaaactactaacgcatacctgctgtaacaacgataatcattcagggaggtattgcacatgaagaaaaagcgttttcgcatcccaattatcggcttgatttgctgtatgctgctgggtacgattgctttcgcagtcaacggccgcaaaatcactgcaacctacggcggcatcaccatttacctgaacggccagaaacaggttgctaccgatgtaaacggcaaggtagtagaaccgttgatctatcagggtacgacttatgtgccgatacgcgctgtcagcgaatggctgggcaaaacggttacatggcaaggcagcaccagttctgttcttatcaacgattctgtcttttctgacagcgacgtttcatctgctaaaaatgtaatcagtgagttctttacgctgttcggcaatcagcagtatcagaagatgaatacgctgtgcaccggcgatgccgcaggatttgactacagcattggcgtattcggtatgaaagaagcaaaactaaagtcctgcacttataacggtgattattccgcaagagccaaagaactcgtttttgaatgttcttttgcaatgaaacccgccgcaaactcggtgtatgaccccaatcaaaccagcactacctgcttgatttatgtaaaaaaggtcggcagtcagttcttgattgatgaatttgcaagcggtttctaagccatcgacatacttatttgaagtgtaatatcattatcggtagatgccggtgatactatataacataacggcatctaccggtagataggggcgattcttatgatttactaaaaatctgcataatcatcgtgctaaatcatttaataacttagaatggttacgtttatgcagataaacaccgtattgttaatctaccaaatactatcctacaataaaagcatgaatgattgtcgcacccatacgatggcaatcatcgagagtacatctgaatatggagggattattaacactatgaacaaatttaagaagatgatgagcacaacgcttgcaggctgcatggccgcgtccgctctgatgatgagcgcaggcgcagtcaatgcgcaggatgttccgtccgcagcgctcgcaaaccctcagtcgatttcggcatttgccggtgataatgttactgtcaatgtcgttcacgtcaaggccgatggcagcactacgcagactcccgtagaagtagcaatccccgaagatacgaccaacgatgagcagggttctatcattgtaaatgcagctgtacaagcatctgattctactggtattatgcttcaggctgcgagctctgccccgaatggccctcgtctcggcgcttcgcacactgcaacggtacgtacaaatgttgacggcacccaaggtgtcaccttagccgaaggtctggccagaaatgttgactacagtggtttggcagtatatatgcacgatattgacccctctatcaccaagatgaacgtcagcgtttggacttctgcaatgggtcagagcaactgctatcagctgagacgagttgttaataccaacagcgaatgtactgtactcttttatgatgatattaagtatggtgcagataattttatcatcagccccggcgataacattaccgcttttggcagcgcggtatcgggttctggtaaggtaactaccgaactgtacggtatctactaaacatctatcaacgaagcacaatgaaagtaactgttgtgcttcgttgtaatattataacaaccatagaaagggtgtatcgtatgaatctgaaacgtgtattgggaagtgttgtttgtgctttctctctgatggcagcaggtattggcgcacaagcagcgaatattccggcacacactgcaacgcgaatcaccgaacaggcagccgcgcagactacaacgcagacccacactgctgtaaaaatcaatccgcagaacgctgacatctatgtcgagggcattccggtcactttcccgagcgaggacggtaagatagtttacacggcgctgacctacaacggctcgacctatatgccgttgcgtacggctggccgctggatgggaaaaaatatctcgtgggacagtgcatcgcgcacggtgttcctgtcgggcagtacggagaagtcgtatccgtgtgcagatgatgatgcgtaccatcaggaaggtctcaaatatgtgggtgcaactggtaatgcaacactcgataaaggcgtaaaggtgctcgttgacggcaaactgcagaccttcaagaaccagaagggcgaaaccatttacccgatgttctacgagaactctatctatctgccgctgcgcaacatcggcgagctgaccggcatggacgtaacgtggtatagcgccaaggctgagaacgatgtgaacgcaatcttcctgcggatgccgctttcggatagcaagcgtaccgaaatggaaacctatgcgatggggcttatgaagcagctgctcgatatgcgcgaggatatgaaaaagtttgataattgtgctgttgaggtcaagaacagcagctataccgactacgtgattaccgacaaggcaactgccatggcggcgctggattccatcaagcgcaaggcacagaacatccgcagcagcatgaccgagcaggcaaatccaatccgttactacaacagcagcttgatgaacgggctggattttcttatcaataacgcggataccgtgatgaaccgtgtgcagaacggccgggttgtgctcggcagcagcaatccggatacgagtgtagtcgatgaaaccgctgtaatgttcggcgctgctgatactatgctggattgccaacgtatggttcgtatgttgcggcagaatatggatatacttttttaatgaaccaagaccataaaaagctgaggattacctcagctttttatttatctgacaattttccaattcccatctaccagtttcagcacaagctcaaactgcgaaatctgtgtcattttcgtaacgctgtccagatattccacggctacagttgccgttacggtatcgccgttcttattcagcacagtgcttttaagctggctgaacgtgtagtccgcgcacttaaccggcggcatggaatccccgccgacgtagtaagacaactctttttccgtagccgttggatacaacgtgaaaaaggtggtcagaaaatccgtaatgtcctcgctctcagtcgcagaaaccgttccatcgggttctgcggcttttgacgtatatgcggattttgcaggctttccggtaatagtcggtgcttgcgtgataaccatatcgccgttatcggccttgtggaccatcgttttgtaaacgcttgatacggtgtcctttttcttgccgtccgagatcgtctgcgctaccgtgaacacgaccgcaaaatcgttttcaccgccgttctgctccacagaccaaatctgaacgtcctgtacagaagaagaaaccgcaatgtcacttctcacggtgtcggcagtcaaacgctgcagatcctcggtcagatagccggtcagtgcatctgtacgctgtgcaacagaatccttgttaccgctccacgaatagtacgttttcgcaaagttccgcacaaacgcttccacaccgctggtatcctccactcggcgctcaacaatctccttttcgtgaacggtatgcgtatcaatcgcggtaaaatccttgtacactgcaaacgcaaatccacagatgaacagcagccacatcgcaatcacagcaggtttacggctgttcgccgtgtagatacgcagtttctttgttttctgctgctttttggtctttttctgaaacataattcgttctccttttcgttatttctgtgcaaccacagcgccgccccagccccagccgccgaagccataataagccgtccagccctctacggtatcaatggtagtgccgccgatattggaaataatctggccgtttccgatgtaaatgccgacatgacctgcatttcgtccgcaggtgtcgttcgttcgggactggtacaccgccgggtcattataaaccatcgcaccgagcggaatattcttgctggactgtccaaccgtatacaacgcacgatttttgcccgcacagcaatgccggtcgatggacacgcccgcttttcgataaacttcttccgcccatgtttcacaatagccgccaacagccgaaataccgtactttgccgaattacgcgctacctcgacaatgcgattctgcgcgtccgttccgagcgcgtcaccgcccgtctgcgtcaaaaactgctttaccagcttgacatagaacatattgccgtaattgtatcgccagccgccgttgatcggcgtggaaatctcatttttataggtgactttcacaccgccggagtgctgacgcgaaaactcctgtgccagctcaaaggtgtatcgcttaccgtttttcgcaacgaagtccagaaaaccactgccgtaattgtaggcttgaattacagcgtccatatcacagccgagcctatcggcctttgcgaccagttcggcaaaatacttgcagccctgcttgatactgtcctctgtgccgagcgtattcaccggcagtccggctgattccgaggactgcatgacatcttccagcttcccctcactttccacttgaatgatggcaagcaggacatagacataatcgctgataccattctttcgcgcgtatttttcaaccatgggctggtgcgcaagcacttccggcgagaggtttacaccgatgtacaaacccgaaccacttccgccgctatcctcatccgaagcgataatcagaaacatcgacagaagtaaagcaatcagcaatccgaagcccagggcacctgccattgccgcctttttcatcacttgcgctcacctcggctctccgaacgccgctgtttgcgcgtgatttttccggttttccgctgtttgaactccgcaccaaaggtttcttcgtccagtccttttggcattgtatatcgtgttttcggcttgtccggcaccatcggacgttcttccggacggtccggcttgcggtctgcaaccgtagtctgcgacttatccttgaccgttgggcgatcttctctctgtttcggtgtcggttcaatccgttccggtcgaggccgattctgcggcgcagatggcttttccggttcggctttctgctgtttggggacagttgggcgctcccgctgtacagaattgctgttctctgtcctcggtttctccgtatttccctcgctgcgttctcttttccgctgagccaactgttcccggcggcttgccgtaatagtcctacgagattccatttgtgcggctcgcgcttccttacgtttctgcatggtttccaccacagattgacgtgtagattcaatattgctgtgaactgcgtattccgcattagtcggcgcatccttgaccttttgcacggtttccgccgccttatcccgcacgcgagatggcgtatccgcaatcttgcctgccgtttcgcctaccctctgaccgaaattcttcttttccggctgaacggtttcgcggcttgcgctttcacggttagcagaggttgaagccgtccgccgggcactttgcacggcgcggcgctgtgcagaacgttttccaactccaacacccgccgcaaatggcaatgcttttctcaccgcacgagagatcgtccggcgcggccggtttgtcatggctcgaccgacacgacccgtgtcctcatcgcgcaggccaatcatgccgagcagtttgtcgcgttccatgtacacgcccgcgaacacgatcacctgcagcagcacgaccaccacgaacggcttgccgttcgcaatcgtgtaggccagcgaggacagtaccagcacaaacgtggtcagcagtgttgttcccactctcagcatgattgtgttgaacagcgaaatcaccgctcgcctgctcgtgccggaaaacgccggaatcatgctgatcagcaaactcaccggcaggaacattgcactgatgatgaacaaaatctgtgacaacagcatactgcctgtcagcataatcgcaaacgccgacacaatcagattgaaaatcaggaagaacacggacaggccaaaccggcttgtcacctcagttacggtcagattgccgttgtcgtagtcctctaactctgttttcaccacttcttccctgtctttgccgcggttttcgtccggcgaagtgccgagcaggctgtttacccgttcctctccaatgttctccacatccgaatcgccaaactgcataataagccacggctgtttcacttgaatcccgaacaaacagtcccgaatcgcagaaacgcccgtgttctcgcctgccgtgtccggcgcaaggattttcgcgctcacatcgacaataccgttgctgatgtcgctcgaaaactcgttgacactggtaatcgcggatggcgcgtaggctatcagtccaaccgacaccacaaacacgaccacaaaattcagcgccgcatgaaacgcctttgtggtttctcgtttgattaaaccagcataagtgcagtacacaccgaccagcagtgtgacaatcgccatcatgccgggaaacagacccgtgctgtccaatccgctagccgacacaccagcaatcagttgaatatttttgccgatttcgcttgcggcactgctgatgaagtcgaggtcatacgcctgctgaatcaggtagcccacggcatttgaaatgtacaaattcagcgtccacaggaagttcgtaaacaggtaaattgcgtactgcgccgttttcccgataccgtccagccagttccacggcagccaatcccacgaggaatcaacataaaagtcaagctggtagttgtcgatcggatacctgctgaactcgtgcgccgtatcaatggtttcgtccaacagaccggcggcgtgtgcctgcacggtgaacaaattgaggaaaagaaaagccatcacaaccgcaacaaaggctgtaatggcaattttctgaacttttgaggtgtttgtcacacatcacacctcgtttcctgtaaccggcgggcgcgtatcaaacgcattgaacaggtaatcgaacatgacatggaacttgataacgccgacacgaccgtacaagtcttggaaaaggcactgaccgttttccagattgcgaagccgtttctgattgttttcatcctcggaatccagaccgaaaaattcaagcgttttcttgatctcgttaatatccgtagagcggaacgcaaacttcatgccgatgttgttcttgatattctcgtccgctacatcaccggcgttctgggtgaccaagtaaacggcagcgttcatcgaacggccagcgcgaaccagtttatttgccagcgttttgccctgtgccacattgaggaacgcccatgcttcatcaagaccaaccatcttgaagatacttctatccgaatggatgaagtccagcgcaaaggtggaaatgacgatcagcatggagatcgacagcatttcgatggtggtatagtccgcaggcgcggtgtctttgtccggcagaaccagatcggcaacttggataatgttaagctgcttttcaaggctaatcgtctgcttcactttgccattcgagaacagcaggtgagcaaagtcatagtccgtaaacgattcaatatgatcggcaatcgcaagcgcggtttccgagccatcgtcccgcagcgcatcaatgacacggagcaggccgcgtgtttcgctgttggtcacggcacgcaccgcacggcgaagaatgggaaacattttgccatcacgggaggaaatgccggtaaggaatgtgagcacatcaagcgcaaggctttctgcgtccttggttttccgcatgatgatatacgggtcgagcatacccttgttttcctcgtccgaggtcagattgacaatattgatttcgtccgcgatctccggcagcttctctttccaaaggccgcgctcacttttggggtcaaggataagagcctgtgcgccgttcagaacagaatagtaggtcaacaggttgaacgacagcgatttaccgccgcccagagagccgagaaacgcaccggacagcgcattggtaacagaacccttaacgccctgtgccgcccttgcaggcagcacatacacattttggtcggtatcgacattatagccgaggtagataccgtcccgctcaccgagcatttgcgttgcaccgaagcccaaaccggcgagaaaatcactggtgacatactgcacatagtcgttcatataccgtttactggacgggataaactcgttatgcagtcccatcatatcaccgataggccgaaccaatttgatactcgcatcatcgtaaaaatcgcgcacctgattgcagcggcgtttgagttcttccacatccggcgcggtaacacgaaccacataagacagcttgtacatagattccttgctctggtcaagcacggtttccagttcgtccacgctatccagcgcttccgcaacttgattggtggtttccgagttattttcccacgcatggttatcgaggtctttcaactcttttttcttgttgcggaccgtatgtaatgcggccttgttcgtgataatctccacattcatgctggtatcaatggcaaaatcaaactgctgctcttggaaatagaaaatctcgctggacggaaaatccagttcaccgaccacatcggagatcgtaaagtatgcgacatagctttccgaatcctcggatttcatatgcaaataccgctgtttttcttcaatcaagcaatgagcaggcttgataagatcgtactttttgaccagcgtattgcgcttacgctttttgagcggcagcgtaaactcgaaatcctcatacgctgtgccggttctgccatagatatgctccagcagatagccaaagtcgtttttatccagtcgtcgcaccttgaaacggcgcgacagcttattttccatcagcttttccatacgggaataacggcggatttcgtcgttcggcatggaaacaaagtcacccatgaaagaactgctgatggcatttgccgcatcggatagcacgtttttcacctgttttcctacatctttcatggataactctttgtccgtcacaaccagcttaaagcccagaaagaagcggtaatcgacctgtgtatcaccgagcgcggcaaccagattttccgtctgctcgtcaatctcggtgtatgcgatctctttcagccgtccggtcacgcttttcttggagcgttcctgcgcggcgcggatactgctttccgtgctgatctgcaaagcgtgaatcttgccgtcacggttctgcgcgatcaactgccggaaagcatcatgcaccgcgtctttctgttccagtgagagaaacgaatagttgaacggaataagttcataatacgcaaagcactcgccctcgttgttccaaacgaggttattttcgatatatttaatgggatacggcacggataatttcactcctaaccatagtaatttccgcattttcgcggcgtttttgcagccgaacaggctttccggcaaaggtgactttcggacgaatcgcataggcaatcaccgaacgcatgaaactatacggtttcttgccgtcaaacgtctttttgctcataaaccatgtcacgccgaacggaatacagcacaaaatcagcgggttatgaacgaacgccaacggcggcactttacggaacgtgaacaccatcacaccacttgccgccaaccagagcagctgggtcacagtgacaggtgtcggcagtttcgcatcaccgaacgagtatatcacctgttcgactttccatacactgctgtaacttcttagttttttcacatcataaattcctttcgctttctacattagggtatagggggagaggaacgagttccagccgcaggcgtctttcctctccccctgcacggttgatgtataactccctgtcggcagttacacacagccgtgcttcaccccctcaccattctcgcagcggccctccttttagagaacaggattctgatttttagcaaagtgtttatacacattttccacactgccatactctttgagcagcgcacccgtattgttctgaacagattccggcagatattctacaagctggcacaggcagttcagttcttcgatcatcatatcttcgtcaatctcgaacggcagttcgtagtcacggataacgtagtccggctcctgatcggtcacgccaatacgttcttccagctcgtcatagtcgatgggcggcgtgaaccacgcgccgaccggctcgatttcacgggtcttatcccgcttttcgatgtaaactcgcatttctaacatagttcttacctcactagttcaaacacgccgtctttggtttccacaaaatcgccctccatcgagaggtcacgcccgtactgcacactgtcaaaataccggcgcagcgtttcatccgaaatcagaccatcatctaacatctgctctgccacatcggccgttgtatcacatccgctccacaggataatatcgtccgcgtgttcgcagaaatcctccacgccgctgtaataactgagcagagaacccatgttgtcccgaatatagtccggcaggttctccaccatttcacacaagcggttgatctcctcgatgggtgtatactccccgatctcgaacggcagttcaaaatcatggattgcgtactcctcgtactggtcattcagcccgatacgctccttgacctcatcgaaatcaataggcggttcaaaccacgcgccgacaagttcgccctcgttgtatttgccgagattggcaatataaacacgcatttcttccatgttttcacctcattccataagaaaaggctgacttttcagccagccttatgcaccaagaatctgattgaacagattcagcagaacatctttaacacctgccgcgttgaacaccagaccaaccgacagcatagccaccacgaggaagccgatcagcttggtaaactcgcgcttgaagccgagatacaggccaatcaccacgatagcaaccagcaccagcggctgggcgttcgacagcagccagttatacagattcacgccaaaattcattagttctcctccgttttaatcatttcattaaccgttctcatcttctgctgaatgattttgcggtgcttgtcccgcagttccgtattatccaaaatgtcttgtacatgggacgttccgcacttttcgtcaatcagcatgagcatttttgccgtcggcgcgacctgatgagaaaaccagttcagtgtccgctccagcgtgtatggttcgggtgcagtcgtcagtttgagcgtgttccggtgcttgccgataaaggtttcccacatcgggttcaacggccattcctcacgaggtttgccgctctccttatccacaaaacgcacatagcggttaataataccaaacgccgtttgttccggattctcattcgacacgagatcgtacacggcgttgtccgcccgctcatttttcagccgaatttcaaagcggttctgaatgtctgcctgctcgagcggcgtaccgttcttcacaagttgctcgtaggctttctcgtaaagacaaaagtacaaatcggactgcatcgagccgatgtacagcgttgcgcccatgtgggcgctgtcctgctcctgccgactgaccagtccgcccgagcgaaacgcccgaaaactgcggaacacggaaacgcactcctccttgcgacatttgctgatgagcagcggaatatccagtatacccaccagatcattcaccgcgagatctactcgtttgaacaccgccttttctttcatgcacttgcggaaaaattcgtaccaagtacgcttctggccgtccagatacgcttcaaactgccgacagcctttgccgcgcaattcgagcagcacgcccatttcttccagcggcgaggtcagcaccatcacgtcaccaatccggtaagtgcttgtatagccgtacatcccgcgcggctcctgcaccagatatttcattttcagccgcagcacatcttcaatgacgtgcttcacatccatcgtcggaaagcggatacgcacataatcgaacagcagtgtcagcggctctggatgcagccgaatgagcgcgtctttcagccgcttgcgtaccttttgcggcacggactggttttcctgctccaatcggcggtaatactccgttgtcaatccggcttccagagccatatcctgttcggatacgccaatttgcatccgttttgcccgaaagtccgttatccaagtcctgttttgcaattttacctccgtttctgattgattttgttcaaagttttgcgcagttcgcctatcttgtccgatttgtacccccctgttagataaagggggttccgacgtttgggcgcggctgcgccgcgcccaacgcaccgttccgtgccgtcggttttcgcgctgcacgccgccgcacggacggcgcgaaggcacaatcagcaatttctctgcactttcccaatctcctgcaaaaagtcgtaccctttcggcacgatcggagtataaaactccgtaatcaccccctttccggtatcggcataacctctgcctttgatatttttgaagaaaaattccttttttgtttcgccaaacatcatactgtatccgagttcggacattctaccaagtgcaactcggaagttaaactggtcacggacaccgtcaccgaggtattttgcatccgggcgctggcaggcgagaatcaagaagaagcctgcctgccgtcccagcatgacgatctgccgcagcttgttcagcacatcttcgcgctccctgctggtcagcatttccatgaacgcaacatactcatcaaatacgagaaactgcggtgaaagtcccaaatacgcatagttttcgccggttttgtaattttccatgtgtttcatttctgcactgcgttcgtacatggccgtgcagaaatcagtgatacactgcacgatctcctctttgcggctgaatacgttcggcaggacggcggataaatccgctaaatctgcgtttttcgggtcaagaatgtacaaaactgcattggtttgccgcaatgcccgaatcagcgtcaggataaagtacgttttgccgccgcccgtgccgcccgcgatcagcatatgcggcaggccgtcaaactcccaataagtgttctgcatgagccgcatttggccgtgctccacgcgcacctcagagatggggatacggtttgcgatcatgtcatacagcaacgtgtactccacaaatccgtccaacagttccctgctgaccagctcacaatacagaccgctttccagcttgttttccaaatgcagcagcggttcttgaaactttcctagcgtaatctccgccgtgatatgcaaaagcccgttttccatgcggtaatacaatcgcggaaaacgggcaatcttcgattttgaacttgcgggcaggtccttaaaaaatccctctgactgtttggtatcactctgctcataccactggttttccagcaccatgcgcgccagcttttgccgatggcgcatttcattcagcttgtccggaaaccggcggtacagcagccacgccgtcacggtacacacttttacacccatggccgcgctgaacagcaggtaagccatggacggactgcgccagtctgtgcggatattcagcagtacaaatgtcacggcaaacaccacgaacagcaggaaaaacaccgtttggaacaccaattttttatcgctcgggcgaatccgcctgccgcgatttttccacagtctgtgcattacggtttcttatccgccggaacgtccttgtgtggctggctgttctgcgcgggtgttttgagcaccagattgtccgccttaatgtaccagtccacctctgcgctgttgccgaacgtcacatgagcgatagcaccgaacatcgggttgaccagtttcacttccgcgttgtacgcaaaatcgcgcaccggcacgctcgccggaacgctgacctgaatcatgcggccctgcttgtcgcttttcaaatcgtaggtgcgctccttgaccacatcggacggcgtgccgtctgcgttctcctcgaacacctcacggcgcattgccgaaaagcgcagcgtgccgagcgttgcttcattttcaccgaaaaaaccattgctgaatctcataaatcgtaccgtcctttctgtttacgccttttcaatatcttccgcgtgcagaatgtaatccacgaacgcccggccgttgataacatagccctcagccgtcaccgacggattcttgagcttgaccggctccatgtatgcgaactgtttctgacctgccgcgccgtcgatcacgacctcaatatcatccgcacgctgtacatcgctgaacagcttgtagcgtcggtacagcaccttggtctgggtgccgttgcgacgggtgtcgccgcgcttcacctcggccggaccgccaaattccagattgccgagcgacttcgccatgttcgggataacaaatttcagttccataaaaagacctccaaattctaattcattacttccgcgatacccgccatcacatattctgcgcacggcagggcaatcgaattgccaagtgcgcgataacgggcatgatcgctgatttcttcatccttgcagccgtacttcgtccagttttctggcaggcccatcaaccgctcacattccagcggtgtcagcacacgcaggaatccgtcctgttcctcaccctcgtaccaaaacgaaaacggtgccgttacactggcaagcagagttgggaacggctctcctcctcgtccgaagctggcgcagaatcctttctgatctccgacctgtgccatggttcgcatacgccggagggaaaacggtctgacgatgggtacctgccgccctgtttgagcagcaggtactccacctctttgggtggcggacagcccgcccggactgccaatcgcagaaaacgggagcacagtcctgggcttaaataatacttctccggcacgctggcctgcaaaatccgccacgacgaacacacgcttgcgccgctgtacgagggcgggttctccccaatactgggcgtccagtagtcgccaagcggtatcagcgcgtccccctcgcaccattccggcgtgtgcccatccacgaggaggcactgaaacctcggcacctgtgaacgcactgagcatggctgcaaaatccagcctgtcatttgaagaaaacgctcccgcaacgttttcccaaatacagaaagctggataccgaccattggttgcatatctcatctcctcgataattcgcatggcctgatagaacaggctggattttttgcccgcgaaaccgtttctcgtgccaatctgcgacaagtcctgacagggcgaaccgaatgtaatcacatcgaccggcggtatctccgcaccgctgatcttcgtaatgtcacccaggtgcagcatattggggaattgccgtttggtaatggagatcgggcgtgcttcaatctcactcgcccacacaggctctatgccgcagtgtaccgccgccaatggaaacacgccgattccatcaaacagactgccgagtttaagtacggtcacgcgcatacctcgtgcggcccatcgtgccgtggatacgacagttgccggtgcggattttcttaccgcgcacacgggcaaggcagtcacaatgctcgtccgggtccaagtgtgcgccgcagtgcggacaggtgttgtagtacatgagtatccctcctatatcctatacataaattgctcttgttttttgcgtgcttgacggtggaggtcgggcaagaactccagccacgatttctttccgataccagcccatataaaattccttgaactttctcctcccgcactactctctataaagcaaaaggaccgtcccttatccttaaggtcggtccttttgcttgtgtcgatcagtagcgtatgtctgccaaaatgtctgtcaattttccaaaatttcagaaacgagggtctgcaactattttttcacctacatttcaagccatcattatttagagctttttctgcaccaaaatcggtaaatgcatatttttacttaaaatatcagaactttttcgatagaatctatacaatatggcagcacactataacacaggtcattttccacatatttgtaactctgactctgtttgtgagggttcgaatccttcttcggctgccaccgaaaaccgtcttttctttgaaaagacggtttttcttttgccttttcgtagttttcctgtgacggctatttgacagacggcctctctcccgatatactaaagtatatataaaggagcgattaccatgttttgcatgaactgcggcacgcagctgccggacggcgcaaaattctgcatgaactgcggcacaaaggtcggtgaggtcggcgccagcactgtccctgccggcaaaaaatatccctcgtacgcgatgctgtacccggacagcatggcttatctcgagtcccctgcctatcagcgcgagcgcggtctgatgaagcagtccgaacttggcgcgacgccgtatgcgggttttgactttaccaactacgtttcgctcgatgacggcacgatgatcggctttgtgttcgggcacaccgcgcgttaccgcgctgccgaggacttcggctacaatctctaccgcctgaatccggacggcacagctgttttcctgaatgccggctgcagacgcggcggctccgagctgtatgtacaggacggaaaagcgcactggacggtgaatggagaaacgttttctgcatctatttgagcattaaggcacctggtatcaggtgctcttattttttgcatatttttcgtaaaaccgcttgacttggagcacactccaagtgatagagttaattcagaaaaaatattcaggaggaaaactatgtatatcgagaacatcaacggtcccgctgacgtgaagaagctgaacattgcgcagatgaccgtgcttgcatccgaaatgcgcgatgcactgctgaccaagctgagccgtcacggcggccatttcggcccgaatttcggcatggtagaggcaaccatcgcactgcactatgtattcgagtccccgaaggataagtttgtattcgatgtttcccaccagtcctacccgcacaagatgctgaccggccgcaaggacgcttttctctacgaggagcactacgacgacgtttccggctacagcagcccgcacgagagcgagcacgaccatttcaccatcggtcacacctccacttcgatcagtctgtcctgcggtctggccaagggccgcgacctcaagggcgaggacggcaacgtggttgctatcatcggtgacggatcgctcagcggcggcgaagcgctcgaagcgctcgactatgtggcagagctggacggcaacctgattatcctcgtcaacgacaacgatatgtccatcgcggagaatcatggcggtctgtatcagaacctgcgcctgctgcgcgagacgggcggcaaggcagaatgcaatctgttccgcgcgatgggtctggattaccgctttgtagccgacggcaacgatattgcttcgcttatcgaggcatttaagaccgtaaaggacagcacgcagccggttgttgtgcacatcgtcacccagaagggcaagggctacgcgcctgccgagcagcacaaggaggcatggcactactgtgctccgttccatccggagaccggcgagccgctgatggacatgagcggcgagtgctacgagagcattacgctcgactttatgatgaagaagatgcaggctgacccgtctgtgtgcatgatcacctcgggtacgccgaccgtgcttggcttcaccgaggagatgcgcaagaaggtcggcaggcagtttatcgacgtaggcatcgccgaggagaacgcagttgcgctggcgtccggcattgcggcaaacggcggcaagccggtctacggcgtgtacagcacgttcattcagcgcgcttatgaccagatttcgcaggacctgtgcatcaacagcaacgcggctaccattattgttgcgtggggttcggtttacggcatgaacgatgtaacgcatctcggtctgtacgacattccgatgctggcgaacatccccaacctggtttatctggcgccgaccaccaaggaagaatatctggcgatgctcgactggagcattgagcagaacgagcatccggtcgctatccgtatgccgggcggcgcactggtttccgacggaaaggctgttactaaggacttcggcagactgaacacctacgaggttaaggagaagggcgcaaaggtcgctgtcatcggtctgggttcgttctacccgctcggtgaacaggcggcggcgctcatcaaggaaaagaccggcgtacagccgactcttatcaacccgtactatatcaccggcgtggatactgacctgctcgagagcctcaaggcggatcacgacgtggtcatcacccttgaggacggcgtactcgacggcggcttcggagagaagatcgcgcgtttctacggtgactccgacatgaaggtactgaactttggtctcaagaaggagttcctcgaccgctatgacgtagacgaggtactgaaggacaatcacctcaccgcagagcagattgcggaggatgtggagaaggttctgtaagattccctttccattaggtattcggtaactctccttcgcagggcgggctgctctacgattctctaaacactgttgcacatatttgtgcatgaaaaaacacgaaaggcttcggagcaatgctccgaagcctttcgtgctgtatgtcaagtttggggaggtttatgccagtccaagttcctttacacgagcctgtgccgctgccagacgtgcgatcggcacgcggaacggcgagcaggaaacgtaattcaggccaacattgtggcagaactcgacggaggacaggtcgccgccgtgctcgccgcagatgccgagcttgatgtccgggcgggtgcgcttgccttctgcaacagcgaagcggatcaggcggcctacgccgttctggtccagacgagcgaacggatcggactcgaggatcttcttgtcgaagtaggtctccagaatgcggcccacgtcatcacgagagaagccgtaggtcatctgggtaaggtcgttggtgccgaaggagaagaactctgcttccttggccacatcgcctgcggtgactgcggcacgcggcgtctcgatcatcgtgccgaccatatacttcatcttcaggccggactgctcgatcagctcgtcagccttagccttgataaccttctttacaaagcgcagctcgttgatctcggataccaacggaaccatgatctccggcgtgatatgcaggccgtcttccttccagacattgatagctgcggatacgatagcctcggtctgcatctcggcgatctccggataaagaacgtccagacggcagccgcgggtacccagcatcgggttgaactcgtgcaggctttctaccttgcccttgagcttctcaaaggttacgcccatctcatcggccagctccttgatctcgtcatcctcgtgcgggaggaactcatggagcggcgggtcgagcaggcggatggtaaccggcagaccgcccattgcgcggtaaattgcctcaaagtcgccgcgctgcatcggcaggatcttggccagagcggccttgcgctgctcgagcgtatcggaaatgatcatctcacgaaccgccttgatgcgagccggctcgaagaacatatgctcggtacggcagaggccgatgccttctgcaccgaacttgcgggcctgcgttgcatcacgcggggtatcgccgttggtgcgaacgtgcagggtgcgaatctcgtcagcccagcccatgaagcggccgaagtcgccggtcagctcagcctcctgcgttgcgatcgcgccgaggtatacgttaccggtggagccgtcgagcgaaataatgtcgccctcgtgtactaccgtgccgtcggcaaaggtcagggtcttatcctcttcggaaaccttgatgccgtttacgcctgctacacagcaggtgcccatgccgcgtgctactacggctgcgtgcgaggtcatgccgccgcgggcggtcatgatgccctcagatacggccatgccgtcgatatcctccggagaggtctcctgacggacgagaacagccttgattccggtcttgtgggccttggctgcatcatcagcggtgaagtaaaccgcgccgcaggctgcaccaggagatgccggcaggccggtggtgatcggcgtagctgccttgagcgctgccggatcgaacgtcgggtgcagaagcgcgtcaagctgctttgcctcaaccttcataaccgcctgctccttggtgcagacgccttcgtctaccagatcaaccgctaccttgagcgctgcctgtgcggtgcgcttgccgttacgggtctgcagcatgtagagcttgccgttttcgatggtgaactccatatcctgcatatcgccgtaatgcttttcaaggcggctggaaatgtcaacaaactgctgataaacctccggcatggtatctgccagcgcggagatcggctgcggggtgcggatgccggctacaacgtcctcgccctgtgcattcatcaggaactcgccgtacagcttcttttcgccggtggccgggttgcgggtgaaggctacgccggtgcccgaggtctcgcccatattgccgaataccatggactgtacgtttacggcagtgccccagctgtgcgggatgtcgttcatgcggcggtaggtgtttgcacgcggattatcccaggagcggaatactgcgcggacagcctccatcagctgcttcttcgggtcctgcgggaaatcttcgccgagggacttcttgtagtgatccttgaacaggacgatcagctcggacatatcatctgcatcgagctcattgtccatcttcacgccctttttgtccttaacctgatcgataaactgttcgaaggaggacttaggcagctccataacaacgtcagagaacatctgaatgaaacggcggtaggagtcgcgtgcgaaacgcgggttattggtcagcttggcaactgcttcgcagatctcgtcgttcatgccgaggttgaggatggtgtccatcatgccgggcatggatgcgcgcgcacccgagcgaacggatacgagcagcggcttctcgggatcgccgagggttttgccggtaatcttttcaagctgatcgaggtaaagcaggatctgatcctgaatatccggatagatggtcttgccgtcctcgtaataacgggtgcaggcctcggtggtgatggtgaaaccctgcggcacaggcatgcccagtccggtcatttcagccagattggcacccttgccgccaagcagctcacgcattttgccgttgccctccgggaacatgtaaacatactttttcatttgggtatttcctccgtttcgattgatgctctctctaatactcattctctttatcacgcaagcacattatagcacgttagcggtgaaatattccattgtagtattataccgatttcccacgaatatattgtgcattttgactaatcatgtatttttagccgaagctcaaacgtttgcgtaaaatctatctttttaatttatcagaaattttgtccgaattttattttatcttttctcgtttttctcgatttttatggcattttgggcgtaaatacgtttcatgcccgtcagctttcatttcattaggcgtaatgcacaaattcctgcaaaagaaaatcgacggtctgaggcagaccgccgatagaagcgaatgaattgctggaaaccacgacgctgatcgcagggatgccgtcgtagctggtctcgtagagcttgaccgaatacggatacgtcgaggacgaggtgaacgagccgccggtaaactggtagaaggtgttttcacccagtgcggcgtagtagcggagcaggatcttgtcgccggcttctacctcttccctgtcgtagtagtaggtggtcgtggtgccctcccggatggtgccgagcagcgtgacaccggtcaccgtgccgaaatccggcaccggatagtgcttgctgtagcagcgcgatgcatccggcttgtggttgcggttatactcgccgggagagtacgccgtgccgtcgccgatcaggctgttcaggtagcggatcggcactgagtaagacggtacgccgccggaatggctgctgaccgtaatgccgacaaccttgccctcatcgttgatgagcgcaccgccggagttgccgctgatgacctgcgccgtgctttcgatcatcggtgcaaggtaatcgtcgttttccgggtcggtcaccttgccggtcgtaaccgttgcggcgccgccgcccgggtaaccgagcgcgtagaccgtgtcgccttcctcgacctcagtggtaacaccgaggtacggcagcgtgctgccgactacacggatatgcgcgatgtccgcgtccgcgtcaaagctgtagatcgtgacttcccgcttggtgccgtcgtacatctcagccacaaggcggtaaacgccgttgacaaggtgtccgcaggttactgcatcgccgcgtgcgctgagcacaacgccgctgccgatgccgaggatattattcttataatcgtaggcgtacagcttgaaaatcgccggtacacaggcactgaacacctcgtccgccgtcatgccgacatgtgcttccacagtgaagctctgccgcagatccggctttgccatacgggtgacgatagccgcaacctcgctgcggcgaatgttggtgttcggcttgaaatcatgcgcgttgttgctgcccgtaagtacgcccgcccggtacagacggtacacatcagcggcatagcctgccgacatgtcaacatccgcaatcgcaccgtccgcaatgtcgttgatcgcggtcagggcgtcctccggcagcgcgtttgcaaagatggacgcaaactgtgctcgggtcgccggctgatcgtaatccgcataagtcgtgttaataataccattttccagcgcatacgtcacatacggctgataccacggacgcgcagtctcaaaatcggtcgtgccgctgacataggtgctgtgcagacacgccgccagcttgatcgcctgtgcgatcgtcaggttgctgttcggcttgaactgggtggcgtttacgccgtccaccagcttgtattcatacgccgcctgaacattctgcgcgtaccactcggttgagggcacgtcggtgaactgcccggcaggatacgttgttttcgaggtaaagttttcatagcccgcaaaagccgcaggcagcatgccgaccatcagcgcagccgctgtgatcagactaagcaatcgttttttcacgaattgcattcctcccttttgaggcgtgggtttgtggattgggatacagggccgcagagcgaccctgctgagctgtcgcgaaactacagtttcgccgacaagaggaacggaccgtgggccgttccaaagtcgtccgaaagttcctattcagaaactttctccctctagaagtcaaaaaagcgtgatacatgctcccgcttttttggcatttgcgcagcaaatgctatttcatgcgcgcttccgcgcgaaacacttagaaataccagttaaatagcatctccagcaaaccggttcacatttacttaaatatacaccgattctgtgaggaattggtgaaatatttgtaaaaatcggtttacagaacggtttgcaaaacttagttctcgtaagcggctacgatctcgccgatatacatggtgtggtagtcgtgatcgccgtaccacttgtcctgcacttcctgagccatgtcgtccggtgcgatgtcggtcacaccgcgcttgcggcagatgagtaccagctcggcctcctcgaaggtcggctgaccctctacgaataccggggtaaggccgctctcgtgcatcttatccatgtcacggccggacttggagccgagggtgttcagtgcctgacggttgccgtccttgagcacggtcagggtgaaatactcgcctgcgtctacaaactccttggtgaagcggctcttgcggatatagcaggtcgcactcggcttgccccacataacgcctacagcgccccagcttgcggtcatggtgttccacttgtcctcggtgcctgcggaaatcagcatccacttctgaccgatcagatcgaacggattgaaagacttttcggcaatgttgatcttcttcatgatatgttacctcctgagagaattgtttagcaaattgagaatggaaaatggaaaattgaaaattagcgcaaggatagcgacattctcaattctccattatccattactgctgcttatccagcggcattgtgcggcgcagcttcatctcctgccagtcctcacgcgagatgaggatctggcgcggcttggagccttcggacgggccgatgataccgcgatcctcaatctggtcgatgatacgcgcggcacgcgaatagcccagcttcagacggcgctgcagcatggatgtggacgcctgacggcagtccatgatgacctcgatggcttcctcgatgagttcatcctcatcgtcgcccgggtcgttcgtgccgctgctgccgcccttgttattgcccacctgctcggcctgctgctcgatatgctcgaggatttcctcgctgtactcggcggtgctggtctccttgatgcgggcaataacagcttcgatctcctcgttggagataaagcagccctgtacacgagtcggcttgccctcaccgagcggcgcatacagcatatcgcccttgccgatcagcttttccgcgccggtcgtatccagaatgatacgggattcgatctggctggctaccgcaaacgcgatacgcgacgggatatttgccttcatgataccggtgataacgtcagccgacggacgctgtgttgctacaacaaggtgcatgcctgcggctcgcgccttctgtgcgatacggcagatggagttctcgacttccttggcagcgaccatcatcaggtcggccagctcgtcgataacgatgacgatctgcggcagcacctgatactgctcgggatgaccgtcctcggtctgctctgctttggccttttcagaacgcatgaggtcgttatagccgaccagattgcgcacctgatggtccgcgaacagcttgtagcggcgttccatctcaccgaccgcccagttgagcgcaccggcggcctttttcgggtcggtaacgaccggaatcagcaggtgcggaatgccgttgtagttgcccagctcgaccatcttcgggtccaccatgatgaggcggacctcctccggcgtggacttgtacagcagcgaaatcagcatggagttgatgcacaccgacttaccggagccggtggtgccggcaatcagcatgtgcggcatcttggcaatgtcaccgatgaccggcttgccggtgatgtccttgccaacagcaaaggacaggcggcttttcgcattcgcgaacgccggagagccgatacactcgcggataaagacggtattgaccgtcttgttcggcacctcgatgccgaccgcaaccttatccgggataggcgcgatacgcacgttcgccgcgccgagcgacagcgcaatgtcgtccgacagggcagtgatgcgcgagatcttgatgccgcgcgggatggtcagctcgaaccgggtgacggacgggccgcgcacgatgccgatgatctgcgcctcgatgttgaacgagtcgagcgtatcgagcaggcacgccgagctttcgcgcagctcggcttctgcgcccgcgacagaggcgtgcttgccctgtgtcagcaggtcgatcggcgggtagtcgtagaccggcatgggcgctttctggctctcgtcgatggcaatattcatggcttcctgctcggtctccgagatgttctcggtctttttcgacttggatgccggtgccggagccgcctcatgctccggctcggaaacatgcgccgattcttcctccggctgcttgttttcgaccagatccataatgcttccagcctttttcttcacgttatcacgcagtgagcgcagatattcgtccggtgcgatagccttgcccttgcgctttcgcgggtcgatcagttcctcgcccggcttatcctctccgggcgggtcagtgtcgatcgggatgtcaaagtcggatttacggtgtgcgcggcgttcctctcgacgctgtgcatgcgcagctgccgcttcgtggatgttcggcagctggagaggtgcttcgtagcgctcgcgttcctcctcgtcctcgtattcgtactcgggcggacgaaccatgtcgtacagcgcctgcggcgtaatccggcaggccaccaacagcgacacgatgaacagcaccagcaggatgagcagtgcgccgatggacgagagcgcccactcgagcaggatgtacagaccgccgcccagcagaccgccggacgagccttccatgccggtagagagcagaccgctgagcgtgctcatggacaggtcgtactcatttgcacacgaaaaggcgtgaatgatactgccgatcagcagcggcatgagcgcgatacacgttccgcgcagacgcacaggacccttgggacgcgcaaacagcagcacggcgatgccgatcagcgcaaacggcatgacatacgcgcccttgccgatgagcgcaccgatgccgcggtgcagccacttgagcagcacgccgtcgatcggcaggatcgacagcaggcacagcagaccgacaatgccccagattgcgccccagaccggacgggacaggatcggaccgagttcctccggctgcggctgtgccgcacgcttgcccttgggcgcgcttttcgtcgattttttagttgtggttttccttgcagccaaaacttctatccttcaactttctttgtgattcaatctgacggcgttctgcgccgtttttccgctttctgcggatactctgcaagtatattatagcatagaaatccggtttttaccactgtttttccggaaaacagcggccggtctgctcgtttagccgttctctgcgatgatgcggtcgatggcggctgctacgccgtcctgggcgttggtgagcgtctcgcgcaggcacagatttttgacggctgcgcttgcgtttcccatcgcgatcgggagggccacggcgttcagcatttcaaggtcgttttcactgtcgccgatggccgcggcgtggtcgaggtcggtgcccagctcgcggcacagcatgccgagagcaacgcccttgtccgcggccggcgtgatgacctcgaggttatcggtcgcgctgctcatcacgcggatacccggaatctgttccagctgcgcacgggcgcgcacgagcatgaccgggtcctgactgcggatgaacattttatcgaccgaaatgtggtttgtggcaatatattccgcaacagacggcacaacttttttcgcgcttaaatagccttcattcgacttatacttgccaaattcgatatcatcatacggagtaatgagcaacgtctcccctacatacaccatcgtgatcatgccgatgcgctccaccacagcagacgcacgcacagcagcttcccacggcatggacatacgcatggtgcagcgctcctgcgacacgctcgacagcgtagcgccgcccgaggtgaccatctggtcatccgtgccgagcatgagcgcgaagtcgcgcgcctcgccgcagatgcggccggtggagaccacaacatgaatgccgctctcgcgggcgcggcgcacggcatcggcggtcgccggagagacctgattctgcggattgagcgcggttccgtctaaatcgagcgcgataaggtcgatttttttcatcttctttcctcctgatactggcgctgctgcgccgcatattttccatcttattcagcataccgcagctgggcaaaaattgcaagcaaataaaaaatcgaacatttgttcttgacaaatttggattttgctcctattctatggctcatcgaaaggaggtgaggccatgtgcagcgaaaacgaaaggccggatcggctgatccgcatgctgtacgacatcgcagacgatgcggaagcgcccgcgaacagccggctcagcgcgatcaaggaaattctcgaccggacggtcggcaaaggcgtaatgctgggcggcgagcagaccgaagtccagccggtggagatcgtgtttcggatcgtagacgatacgaattccccgtaacacggcggcaggcagcgttcatgcagtcggatacgctcgaaaccctgttcggcggcgcggcaggcggcggcaaaagccacggtcagctgctcgatgctttgcggtttgcggtgtgctatccgggttcgcggcagctcatgctgcgacggaccatgccggagctggagcgctcgcttgtaccggcggctttgcggctgtatccgcagtgcattgcaaagtacaaggtgagtgagcaccgatgggattttgcaaacggttcggcgctggaattcgggtactgcgatgcggaaagcgacgtgaccaggtaccagagcgcggaatacgatgtcatccggttcgatgagctgacacatttcaccgaaagccagttcacctatctgctgtcgcgtatccgcggcacgaacggattccccaagcaggtcaaggcgacgaccaatcccggcggtgtcggtcaccagtgggtgaagagccggtttatcgactccatgccgccggacaccgtgcgcgagttcgacggcggcacgcggctgttcctgcccgcaagactgggcgacaacccgtttctccgcaaggcggatgcaggctacgagaaacgcctgaagctgctctctcccaccgaccggaaagcactgctcgacggcgtgtgggagctgaacgagggacagtatttcagcgaattctcacgcgacctgcatgttgtaaagccgtatgccatcccgcacgactggcggcgctgcctgaccatcgactacggtctggacatgctggcggcgctttggatcgcgcaaagtccggacggacacagcgtggtctaccgcgaactctaccgtccgggactcatcatttcggatgcagcggcgcagatgcttgcctgtgagacggcgggagaacacatcgactgccgtctcgcgccgcccgatctgtggaaccgacggcaggaaaccggcagaagcgcggtagaactgttcgcggacagcggactggattttgttaaaagcagcaatgaacgcgtcgccggatggctggcgctgcacgagctgctcatgccgcgcaaggatacggacggcgccgttcgacctcggctgacgattttcgacacctgccgcaatctgatccgcacgctgcctgcgctgcagcacgacaaacgcaatccgtccgacacagcgaacacgccgcacgagctgacccatgcgccggatgcgctccgcgggtacgccgcgaccgtgtacgagccggttaaggcggtccctcagtcggcgtatgactgcgaggtaggcgaatttctcaggttttagcatagcaaaggaggatttgatggaaattttatgttacacgctgtctgcggcgatactggtcctgaccggtgcaatcatctccggcggtgtggttctgccgcggcgtttgccgaaggagcacacggcagaatctacgccggaggatacgctcagccgcgatctggcggcgctgatgaactacggacgagaggaggacaacgatgaaatttgatccgtcaccgacggcaatctggaagaaatatgagcgcgaccgcgactacaagcgctcgatcggtttatacgaccgtgttcggcgcaacgaggcgttttacctcggcaggcagtgggagggtctgcgcgtgcagtccctcgacccgctgatcttcaacgtgctgcggcgctgtgtcaacctgtttgtggccatgctggtctccgacgatgtggcggtacgcgcccagccgtttgacatggatgaggacgggcggcagaccgcgcatgtgctcgaacgcgcgtttgcatccgcgatcgagcgttcgggtgtcaaggcactcggccgcccgctgctgaaaaacgcctgtgtggacggtgatgcttgcttctacatgcactttgatccggcgcttgagaccggtcaggcggtcaagggcgatattgcggtggagctgattgattccacgaacatctgcttcggcaacgccgcctgcgatgaggtacagcgccagccgtacattatcattgccatgcggcgcgacgcggacgaggtgcgccgcgaagcgcgtgtcaacggcatctccgcgagtgacgcggaagccattcggccggatgatgtgggcgaataccatcgttaccgcacctcggcggacggcgagcgcgtgaccttactcctgcacatgcgcaggaccgagaacggcattgccttctgcaagaccacgcggaatgccgttgtcatgcccgaaaaggtgcttccctatcggctgtatccggtgacgcacctttgctggaaccgcgtgcgcggctcgtgccacggcgaaagtccgctgaccgaggcaattccgaaccagatcgccatcaacaagctgtactcgatgtacgtccagtgcatcaagcaggtggcgttccctaagatcgtgtacgacatgacgcggttcccgaacggctggtcaaacgacgtcggcaaggcgatcggcatgcgcggcaacccgaatgaagcgatcgctgccgcattccgcgcaccggatatctcggcacaggtgctgcagctgctcaagcaaatgatgaccgatactgcggagctcatgggcgcaagcgaggccgcactcggcacggtcaatccggacaacacctcggcaattatcgcggtgcagaacgcaacggcggctccgctcgagctgacaaaaatggagttctaccgcttcactgaggactgggcgcgcgtgttccttgacctgatgggcgcgcactacggcgtgcgcacgctcgttctgccgaacgaggacggcggcgaacccgaaaaatgcacgttcgacttctccgcactcgccggacaggacatgcgcctgcaggtggatgtcggcgcggcaagctactggtccgaaaccatgcagacgatgacaaacgatcatctgctcgagagcggcgttatctctgacccgctcgtatatctggaaaacgtaccggattatcaggtacgcggcaaacacgacctgctgcacgcgctccgcgtacagcaacagcagcaaaaggaggcaaacagtaatgcagaaaacagcaatgaatcctaatcccgagcaggaaacggcggtcaatccgttcgcacaggagcaggcggtggaaatccagccgcaggaaaatgcgcagacctatccggtcgaggtggacggcgatatcgtcgaactgacgctcgaggagctgattgacgcagccgcgcagggcctttccaagcgcaacgcgtacattcgtcgcaaccgcgcggcaaacgccatgccgaacggccagatctacgccgcattcgtcgaggaatatcccgatgtccgtcccgaggacattccgcagcaggtatgggagtgggcacagcaggaaggctcgctcgtatccgcgtaccgcaagtgggagattgccgagctgagagacgaactggcagcgctcgagatgaaccagaagaaccgccgtgcggcggtcggtccggcgcagtcggacggggaacccacgggagcagacccggtcaccctcgctttgctcggcaagtaacactctcatcacttcacgatttaacatttatataggaggtaaatttttatggctatcaatctcgcaagcaagtattccgaccagattgcggaggtattcacccgtgcgtccttcatcaagggcaaaaccgcggagacgtatgacctgaccggcgtgaaaacgctcaaggtttacaccccgatcacagtggaggaggtcgattacgaccgtgacggcggtctgaagcgctacggcgatgtgaccgaaatgcaggacgtggtgcaggaactgaccatgacgcaggacaaggcgtttaccctgaccatcgataagggcaacaacctcgatcagaatctggtcaagaatgccgccgacatgctgcgcctgcagctgaacgaaaagtccacaccggcggcggacaagtacgcattcaagcgcttcgtcaccatggcgggcagcattgtggaaagtgcaaagccgaccaagtcgaatatcatcagcaagattgcggatgcatcgcaggcacttgacgatgcgcttgtgccggacgacaaccgctatctgtacctgaccagcgaaatgtacaagctggtgtgcacctcggacgagtttgccggtgtggacgtgctggcgcgtcagtccatcgccaagggcgtgtgcggcgaggtattcggcatgaatgtcgtccgtgttcccaagagctatctgccggaggacgtgtacttcctcgttgcacacaaggatgccgtgctcatgccgtacaagattgcggatgccaaggtgcatgaggacccggtcggcgtgtccggtgcactgatcgagggccgtcactactacgacgcatatgtgctcggcgcaaagtgcggcggcgtgtatgcactggtcgatgaggactgccgctcgagcgcaccgaccatcagccagggcaagattaccgcgttcggtaaggtgcgctacaccctggacggctcggatccgcgctactcggattccgcaaaggattacgttgccggcactgtgctgacgccggagaccggctgcaagatccgcgcatactgcgtgcagtccggcgcgtatccgtccgaggtagcggaaggctaaggcaacaccgcacaatgaaagctacggcttgttcaattatgcgatattgccctaaattcaaatagcagataagagttaggagtgaggaggtaggaggttttcttcgtttactccccactcctgccttctaactcttcactgtatccaataaactcatcacaaaggaggtaaccctatgaccggaaccgaatgctttcgtgcagcgctgaatattttatccgaaacaccggacagcggtgtgtattacgagcagtttgcgctcggtgcgctcaaccagctgttagcgaacagcctgcgcgagatgaacgcagaacgtgcgtctgacggcaaagacgtgctgcttgtgccgccgcgcatgatggcgctgaccgaggagctgcccgccggcgactggctggcgcgcgaatgttttccgtacggactggcggcgctgcttgtcgcggatgacgacaaggccaagtttaactgggcggcaaccgagtacagcgaacgcctgctgagtcactgtcccgcgcagtttaccgccgtgcaggagatgatttaatgcgaagctatgaatttccctatccggaggccgagcagcagaccgtggtcagccggttcggcggcatcgactgccgcacgcatccgaccaaggtttccctctcccgctcgccggatatgcagaacatgatctgcgaccagaacgattttctggtaaagcgcaccggatggcgcacacagacgcagtttgacgcacccatctacgggttattcgccatgccggatggtgtgggctgtgccgttcatgcgggtgcaaagctgtattttcgggcgccggacggcacgcagaccgagctgtgcgcagacatgaacgaggcgttttcccagtcgtttacgatgaagggtgtgctgtacctgatggacggcaaaacctatcgtgcggtgctcaaaagcagcaagaatacggcctgggaagccgtttccgtatccggcacagcctatgtgccgactacgaccatctctgcggcgccgaccggcggcggcatcagctacgaggcggtaaatctcttgacgcctaaacgcatcaacacctttatcggtgacggcacggcgacccagttcaaggtggacgcgaccgacctcgacgaaacaactgttacggctgaggtcaacggctcggcggttaccgtttcggcggtcaaccgctcgaccggtctggtaacgctggccgctgctccggcaaacggaaacggtctggcaaatgtgtccatcgcgtttgccaaaaccgtcagcggacacgcggataagatcaacaaatgccgctttgccgggctgtacggcggcaaaaacgacacgcgcgtgttcctttccggcaacccggatgagccggactgtgactggcagagcggcctgtacgacccgacctactttccggacaccggctacacccgcatgggtacggatgcatctgcgatcgtcggctatctcaaacagtacgaaagtcaggtcgtggtcaagtccggcggcgcacaggaggcgaccagctatctgcgcacctacatgatggcggatgacggttctgcgctgtatccgctcaagcaaggtgcgcaaggtgaaggcgcgatttcaagccgctgcttcgccgtgctgaacgacctgccgctgtatctctcggcaagaggtgtgcagggcgtgtacggcaccgccgttgccgaacagcggacgatccgctcggtatccgatgccattgtgccgaaattatcgcaggaggccgacctcaaaaacgcctgtgcggtggtattcgagggcaaatattatctggcagtaaacggacacatttatgtcgcggacggctctctgaccgaggaaaacggcgatccggcgtggtttttctgggtcaatgtgcctgcacagtgtctggcggtgctgaacggtcagctgtggttcggcacggcagacggccggctgtgccgctttgccaaaagcgaggaggagcacgcctatcttgatgacacggcggcgattgccgcgtactggcgcacgcctaccctgccgctctccgactggagccgcttcaagaccgtgcgggacgtgattccgacgctcatgccgcattcccgctcgggcgcgaccgtgcagtacgagaacgaaaacggtgcccagcttgcgctttcccgcaatatggacctgttttccttccgcacactggacttttcacggttctccttccggtgcattccgggcgccgtaacgtaccgtacccgatggaagcagcaccgcagtcctctgtttgccgtgcgcatcggtaacgaccggccggatgagccgtttggtctgctcgcgctcaccatccgctggacacaggggcagaccgtaatttagaaaggaggattcccctttggcaatcatcaaatcaacttccgcgcgccgaacatcaaccgtaaagtcaaccgcgtccaagtcagcttcgtctaagacggcggcaagcaaatcgacgtcaagcacgtcctccggcacgctcaattccaacggctaccgcgacaattttgactactcggcggcaatcgccggcacgactgattcagcgaaacgccagcagctgctgagcgaacgccagaacaagattgactcgctcggtctcggcggcaaggttgcatccaacgacgcggtttcgacgtggaacggcaactaccgtccgtactcggtttcaagcacaacaaccggtgcaaaccgcgtcagcagcctgtatgatgcggcggaaaatgcccgtttcaagcgatttgagatcgcccgcagccgcattgcaaggcagctggagagcaatctcgcatccatcgagagcgactacgccgccggtatgcgtcagaccgacatcaatgcccgacagtccgcggtgaacaacgaggaaaagctggcggcgctcggacttaacatgggcgcacgcgggcaggcagccaccagcggcatggcggagaccagccgcattgcggtggacaaccggtaccgcagcgacctgaattcgcttgggcaggcgcgtctgtccgcgcgtgcggcagcgcagaatgctgccgatgaacagaccgcagccgccgagaacagctactataccgcatcggaaaatgcggcgctccagcaggcgcaggcggcactgagccagtttaacgccgaccgcgattacggcttgtcggtagccggtctgaccggcttcctgaacggcacgccgacgctgaactggcgcaattatcagctgaatgtcagcagtgcggctgcgaatgcacagacccgtgcctacgagcaggcgcttgagcgctggaaaaccagcggatacgttcgtcagagtgacgcagctatcctcggtgtgcccgccggaacgccgaccgccgatgtcagctacaagaacgcagcgctcgcgctgcagcgatggaagaacggctacggcggctgatttttcaagccgcgtctgtccgaaaaaataaatcacctctgcgcacaaggcacagaggtgatttatgataaagaaatgaaaatgtgagcaattttatccaaaaaagccagattctctgtttcagcacagagaattcgctatgctactgcgtttatgatagcacaggtttgtccatccgtcaactcaaacgcaagaatttactatatattcgcaagaaattgctataaaaaaaaccgcacgcaaaagcgtgcggttttctcatattgcagtatcggtaaggacggagacttacttgttcttcaggttgaagaaagccttcttgcccaggaactgtgcaacgtcctcgcccagttcttcctcgatgcggagcagctggttgtactttgcaacgcggtcggtacgagacggagcaccggtcttgatctggccagcgttcagtgcaacagcgatatcagcgatggttgcgtcctcggtctcgccggaacggtgggatacaactgcggtgtagcctgcgcggttagccatctggatagcgtccagggtctcggtcagggagccgatctggttaaccttgatcaggatggagttagcaacgccaagctcgatgcccttggacagacgagcggtgttggttacgaacaggtcgtcgccaaccagctggatcttgtcgcccagagccttggtcagcatagcccagccttcccagtcttcctctgccatgccgtcctcgagggagatgatcgggtacttctcagcgaagttcttccacatcttaaccagctgctgctgagtcagcttcttgccggacttcggctggatatagcacttctcctcgtcgttccaccactcggaggaagcagcgtcgatcgcgatcatgaagtcctcacccggcttgtagccagcttcttcgattgcctgaacgataaccttcagagcgtcctcgtccttcttcaggttcggagcgtagccgccctcatcgcctacacctgctgccggagtgccgttctccttcagggtggtcttcagctgatggaatacctctgcacagcggcgcagagcctcgcggaaggacggagcggaaaccggcatgatcatgaattcctgaatctcaacgttgttggtagcgtgtgcgccgccgttgaggatgttcatcatcggcatcggcagggtcttagcgttgcagccgccgatgtagttgtacagcggcaggctcagagcctctgcagcagccttggcaacagccagggatacgccgaggatagcgtttgcgccgaacttggtcttgttcggggtgccgtcagcctcgatcatagccttgtcgattgcctgctggtcgagagcgttcatgccgataacaacttcagcgatctcgccgtttacagcgtcaacagccttgagtacgcccttgccgttgtagcgggacttgtcgccgtcacgcagctcgcaagcctcgaagataccggtggaagcaccggacggaacagcagcgcggcccatgtatgcgccggtgtcgccctcaacgtaaacctcaacctcaacggtcgggttgccgcgggagtccataacttcgcggccgattacatcaacaatttcaatgtagcccttcataattctttctccttcttacataagaatagattagcttataaaagagtggagagtgaagagtggagagtggagattactccgccttttcactctttctgcttcactctattattatcaataagaatatccgaattgccgagcgttaaatgaagatttctcttcactctacactctcaactcttcactctgcttacttaacaagcagactgtgaccagtcatctctgcaggctgcggaatgcccatcatgtccagcatggtggaagccagatcagccagtacgccgccttctgccagcttgccctcgtgaccgaccattacgagcggcaccgggttagtggagtgtgcggtgaacggagtcacgccgtcagcgtcgagcatctgatcgacgttgccgtggtcggcggtgatcaggcactggccgcccatcttgaggatggcatcaacgaccttgcctacgccgtcatcggtagcctcaatagccttgactgcagcctcgaatacgccggtgtgacctaccatatcgcagtttgcgaagttgaggataacaacgtcgtacttgccggacaggatgcgctttacgcactcctcggtaacggcaggctcgctcatctccggctggagatcataggttgcaaccttcggggacgggatcagcgcgcgatcctcgcccggatactccttctcaacgccgccgttgaagaagaacgtaacgtgtgcgtacttctcggtctcggcaatgcggagctgggtcatacccagatcggagatatattcgccgaacgtgttcttcaggctctgcggcttgaaggcgatctccacgcccggaatagtagcatcatactgcgtcatgcagacgtagtggatcttaggctgtacgcgctcaaagccggtgaattccggatcaacgaatgcacgggtaatctcacgcgcacggtcgggacggaagtttgcgaagatgatcgcgtcgtcgtccttgacggtcgcgccctcggtaacgataaccggaacaacgaactcgtcggttacgccgtttgcgtaggactgctccatagcctcgtgtgcggtagcagcgtgctcgccttcgccgagtgcgatagcgttgtacgccttctgtacgcgatcccagcggttatcacgatccattgcgtagtaacggccggatacggttgcgatgcagccgacctcgacagcgtcgatcttggcctgcaggcggtcgatatactcgataccggactgcggcggcgtgtcgcggccgtccatgaagcagtggaagcaaaccttgcgcagaccattgcggcgtgccagctcgagcagcgcaaacatgtggtcaatgtgggaatgcacaccgccgtcagacagcagaccgaaaatgtgcagggtggaaccaaaccacttgcactggttgatcgcgctcataagagccggattctcgaagaaatcgccgtcctggatggccttggtgatgcgggtcagctcctgatatacaatgcggcctgcaccgatgttggtgtggccaacctcggagttgcccatctggccgtccggcagaccaacgtccagaccggatgcaccgatataggtgagcgggttctctgcgaaaatcttatcgagattcggctttttagcagcctcgatggcgttgcccttggtctcctcgcggtggccgaagccgtccatgatgatcagagcggtcggcttcttcgggccctctgccttcttggcagcagcggtggctgccttgggcttgcggccgcgcttggctgccggctttttcgcctcggtcttggctgcagttgtctttgccgcagcggtcttgcgggtacgctttgccgccggcttttttgcaggagccggatctgccagaacattaaccggtgcggaagtcttgatctcgactacctctacctccggcatgcccggcatagtggtttttttcatactgataaaactcctttacagaagcgaacgataagagaataaaaggggacacgatatcaccatgtccccctccgcaaaacggtgagggagcgtttccctttcccgtatccttatcttactggttagctgcttctacgatggtagcgaagtcagcgctcttcagggaggcaccgccgatcaggccgccgtcaacgtccggctgagccagcagctcggaagcattctttgcgttcatagagccgccgtactggatggtgatgccacgtgcagcgcgtgcgccgtacttctcgcgcaggcagtcacggatagcggagcaaacctcgttagcctgctctgcggtagcggtcttgccggtaccgattgcccagatcggctcgtaagcaatgacaaccttcttaatgtcctcaacagctacgttctgcagagcgatcttgatctgcttgcggataacttccatggtaacgtcctgctcgcgctcggtcagagactcgcctacgcacaggatcgggcgcagaccgttctcgagagcgacctgaaccttcttgccgcaagcctcgtcggtctcgttgaagtactgacggcgctcggagtggccgatgataacgtacttaacgcccagctccttgagcatgtcagcggagatctcgccggtgaaagcgccggacttctcgaagtgcatgttctcagcgccgattgcaatcttggagcccttagcagcctttacagcagcctgaatatcggtgaacggtacgcaaagaaccatctcgcaccacttggtcttggacaggagcggcttcatctcttcgatcagagcctttgcctctgccggagtcttgttcatcttccagttgccggcgataatggtcttacgatatctgcgattcatgttggttttacccctttcaaacattcggacggacttttccgtcttaaatttttatgtatttatacggagcgctcaacagaacgcgctccgatataaagcgtttctaatggacttacttgtcctgcaggcaggcgatgcccggcagctccagaccctcgaggaactcgagcgaagcgccgccgccggtggagatgtgggtcatcttatcagcaaagcccagcttctcaacagcagctgcggagtcgccgccgccgatgatggaaacagccttgctctcagcgatcgccttggcaacagccttggtgccgactgcaaaggtgtcgaactcgaatacgcccatcggaccgttccaaacaacggtgcctgcgtccttgacagcctcggagaacagctctacggtcttcgggccgatgtccatgcccatcatgtcagccgggatcttgccagcctcgtatacgaccggagcagcatctgcgccgaagtgatctgcacaaacggtgtcaaccggcaggagcagcttaacgcccttgtcagcagccttcttgagcaggccgagtgccagctcgatcttgtcttcctcgcagagagaggtgccgatctcgccgccctgtgccttggagaaggtgtaggccatgccgccgccgatgatgatggtgtcgcacttgtcgatcaggttttcgataacgccgatcttgtcggaaaccttagcgccgcccaggattgcaacgaacggacgagccggatcgctcagggccttgcccatgatagagatttccttcttgatcaggaagccgcatacagccggcaggtaatctgcgatgcctgcggtggaagcgtgtgcacggtgtgcggtgccgaatgcatcgttaacgtaaatgtcagccatgtcagccatagcctttgccagagcagcgtcgttcttggtctcgcccttttcaaagcgaacattctcaagcagaacgacctcgcccggcttaacctcagcggccagcttcttagcatcctcgcctacaacgtcctttgccagcttgacttccttgccaagcagctcgctcaggcgcttagcgaccggagccagcgaatacttcatgtttacttcgcccttcggacggccgaggtgcgagcacaggattacagcagcgttgtgatccagcaggtagttgatggtctccagcgaagcacggatgcgcttgtcgtcggtgatgttgccgttctcgtcctgcggtacgttaaaatcgcagcgggcaattaccttcttgccggatacgtcgatatcctcaacgctcttcttgttatactgcataaatatccctctcctttaagatgtattataaagttacgataaggaacaaaagcacgaacttattacttaaataattccgtttccaatacagaattatactcgtaattcgtgccattcgcaagcaaaattgtgaaaatcatcacattccaactcgcttttagaggatttttgcgtttttcgccaaaaagttgcgaaatattaaacaacattcacaatttttgcatcaatcccgcggcgttccataatacgctacagccatcgccagcggaccagtatttgtcagaaccgagggaccgatcactacgcgtttcacatcgcggaatccaatttcggtacgcagacgcttttccatttcatccagacgctcggcgggtacgtcaccgtagagcaggatagccgtctgcttatccggctgcaccacacgggcggagacttttttgctcattccggcaacgagtgccttctcaccgcgcaccttgtcacacacctttaccgcaccgtcatacacatggctgatgggcttgagaccgagcgcctcacccacgaaagccgcgccgcccgaaatacggccggacttcttgaggaacttgaggctgtacacaccgaggtaagcttccacgcggttaagacggctctttaccacgctgacgatcgcgtcgaagctctcgccctgctcgcgcatttcggcagccttgacaacaatgtgtccgtaaatgtaggtgtaggtcttggagtcaatgacctcgatggtcattttgccttccccctgctcctcctcgaacatggattttgcaaggcacgccgcctgataagtacccgagccgccgccgttgatgagcactgccagcagatgcgtgcagccgcgctcgaacgcacggttgtaggactcgaggaatacggtcggcgtagtcatggccgtgccgggaatctcgctgctggtctcgagcagcctgcagtagtcctcggatgtgatgtcgtaatattcgcggaagctgcgtccctcatgcgtcagcatgatcggaacgatctcaatgccgtgcgcctctaccagatcgtgcggaatatccgacgaggaatcggtcaaaatatgaatcttttccatgctttactcctttatgcctgtgggaacggtcccgcaagtctcagattttcaaagccggtctgccgcagtgcctcaaacacgataacagcgaccgagttagacagattaaggctgcgcgcgccctctctcatgggaatgcgaacgcagcgttccgggtgctcgatgagcagcgcttccggcagaccgcgggtctctttgccgaacatcaggtagtcgccgtcgcggtattccacctcatgataggcgtgcggcgcctttgttgtcgcatagaagtagcggccgtccggatttttctcaaaaaattcatccagatttttatacatacgcacatcgagcaggtgccagtaatccagaccggcccgcttcatgcgcttgtcgtcgatagcaaagccgagcggctcgaccagatgcagcacacagcctgtcgccgcacaggtgcgggcaatgttgccggtgttctgcggaatctccggctcgaccaaaacaatgttgagcatactttcgcctcatttacgaactaaacttcttctattttatgcgataacaccgtatttttcaaggtatattcccattttttcgcaaaaaagtttcctctgaacacaagattcagaggaacttttcatgcactatactaatttttgatgattttggacgaacggcacatatcgtcaattactcaatatccgcatagacgccatagatatagccttccgctgcggcctgctcatcggtcagcacttctccggtaaggctcggaccggacgtatcgtccttgtattccacgcccagcttgccggtgtgcagcgtcatcgagcgggtctgctccgagccgtcagtaaaggtgatggtgacggtcagctttgcaccctcaaagccgtccacggccttgtgccacgaatcctgcagatcatcgtccgtggtttccggcatgctcgacagccacaggccgtagctggcgtccgggtcgtacgcgtcggtgaagccgttgtccagcttccagcacaggtcggcgtacatctgctctgcgccctcctccggaccgttgccccagaccatcacggtgtccgcgccgtccagctcggggtttgtgccctgatgcatcgagcgcacccattcatcgcggttatccgatgtatccttgacggtttttgtgcggtagactgcgcccttgtcgatggtcgcggatacggttttgatatcctcgccggtcaccttgaacagacagccggagtagaaacccttttccggatcgtccgcgccgttgccggtatcgaacacgatcttgctgtccttcggctgacgcagctcgccggtatcggccgcataggctgcaaagccgaatgtgtgactgatggcgtccgctacggctgcactgccggtctgcgcggtgccattatgcgtgcgataaaccgccgtgccgcccagcacaataccgaacgcgcaggctgccgccagaaggcgctttgccattccccacggatggcgcggcaccgcatgcagcggttcgttcgtcagcttacgcgcttcacgagctgctgccagcgtgcgctccttcagctcctgcggagccttgatgtccttcagttcgttccagttgttcttcatcgtaagatccctccaaatccagctttaattgctttcttgcgcgatgcagccgcgtgcgtaccgttgccggacggcagccgaccattcccgcgatctcctctgtgcggtagccctccacatagtgcagccacaccgcaattcgctgatcgtccggcagtgcgtgtaccgcctgccacagctcactgctgctttccggttccggagcggcagcatccgcggcagcttccatcggcgcggtgcgcttaaaccacgccgaccggcgaagatcggcgcaccggctgagcgttacgcgcagcagccatgctttcaggtgctcggtgtcgcggaaatcggtatcgtcccgcagcagccggagaaagacttcctgatagacgtcctctgcgtccgcgcggctgttcagtctgcacaaagctaagcggtagactgcgtcgccgcaggtgtccatcgcctgctgcagaaatgcgtccgacctgagttttgtctgcattgctctctcctcctttcaccaacaacacgttttgcagcggcaaatcgttcccgctgccgccggattttttgagatttcggcttgttttcccttcgttttgtgtttccctacaatttacagatgttatttttgtagtatatgcacaaaaacttttgcattttctctagaacattaaacaaaaaatctattgtatttttatctaaaacgactataataataattgttctaaggaacacaacaaatcgacaataaccaacaaccacattggtttttatatttcatttgctctctttttttcttttttctttctttactctttacctgctctttgagggaaaatcgccgtctgattcatcaggcggcttttttccgccttgcggcaaaaaagctgcggtttaaccgcagctttgaggctgtcgataaagtcaatctatcgttttcacttttcgtgcggcagcacgcataaaatagaatttgcacagcaaattcataattcccgggggcgtgtacctcgggaattatacaagggacgaaaaattgtgcccgtagggcgcggcttttcgtcaagattcgattgaaagcgtggtttcaatcgagaggctgctcgaaaaacggagtttttcgacagcctcaaagctgcggtttaaccgcagcttttttagtttgttccgacagtatgcgttacagtgctgcctgtggtatcatacggatacagggtattcagagccgccgcaagcgccggactctccagcgtataccatctgtccttgccatgtcgttctgttttcagcagcagcaactcttccgaatcattcctgcacagaaagagcatataatctgcttccgcgctgtctatttgcactgcaacgacgcacggaatcctggtattcgtgccgtacggtgtccatctgcccggaaagcgccgcttgcccttactgtctgcaagcagctgcacgatcgtctcccgattttccgcagaaagtgtaatttcttcggacgggaacgcatagttataaatcgttttgctcgtcaccggcgtatagctgtacgccttccacgaaaacgaatcatcgactgcacagccgatcttccgtggtgcaaagaatatgccatagatcccaaccgcacaaagcagaaggagcagcgccgctgtcactgcacatttgaccgatttcttcatattgtcttcctcccgattctctatccttattcttgtaccttgatgataccgaacgatcccttgattgtcaaccaaattgttccctgagatacagaaaggcgataccgctatgcagcgataccgccttttcttatttctctttgaaaaattctctggtctgctgcacattttcctcgatggcggtcttgagcgcctccaccgattcaaactgcatttccggacgcaggaacttatgcagctccacatggatcatcttgccgtacagatcgcccgcgaagtcgagcagatgcggctcgatggtcggtgcaccgccgtctaaaaatgtcggctttacaccgatattggtcgctgcgatatagctctgtccgtccaccagaacgcgggttgcgtacacaccgtacggcggcagcgccatttcggtcggcagacgcagattgaccgtcggcacctgcagcacgcttgtgccaacacgccgtccgtgctccacaataccggaaaccgtatacggatgaccgagaaacttagccgcaccttccatatcgccctgcgaaatcagctgacgaatataggtggaggacaccacaatgccgtcaatcttgacatcctcgatgcagtcatagccgatgccggccttttcgcactcgatagccatgccctctgcgttgccctgccccttatagccaaaacggttattgcgtcccgagataatccagcccgcattgaagcgaccgatgagcagcttgtggataaaatcgcgccagtccatgtgctgcatttcatggtcaaagtggccgaaaataacctcgtccacaccgccgagctttttgatctcctcggtgcgatatgcatttgcggtcagcagcggcacctgacggcccatgacaaccgaatccggatgcacatcaaacgtgaaaaccgcactcgtgccgccgatttgcttggcacgctcgaccgcacgctgcatgagcgcccgatggcccagatgcacgccgtcaaagtagccgagcgcgatggcacgcggctttgtaacttctatcataagggaatccccctgaaaaaattgataattgaaaattgagaattgagaatgaatgcggcgcttcgcgcttattaaatcatcgcgcaaggcgcgataccttcattatccattttccattttcaattctccatttctgtttgtatgcaaaaacttatcgaaagtttttgtatacaaacagacccaaaccgcccttatccagctctctcacctgaccgagcataaggaacctgtcctgatggtacacacggcagatggtatctgccgtctccggcagactgtcggtctggcgcggaaatacgactgcgcctctcgcaatgcgctccgcgccctcatcggtgagcgaaacggcgggtctatcggtaaacaggctgtcggtcggcagcagaagctgctgcatggtgccctctgccattgcctgctcacactcggcaaaggtatggcactgcgccagctcatacgcgcccgaacgggtgcgctccagactgtgcagcacggccagcgtgcccagcttttcgccaaggtcattgaccagtgtccggacgtaggtgcccttgctgaccttgcaccgcagcgtgcccttctgggcattctcgtcgaagtcgagcagctccatttcgtgcacaatgatatcgcgcgccggacgctccacttccctgcccttacgggcgaggtcgtacaacttctggccgttcaccttgaccgccgagtacatgggcggcacctgctgctgcggaccgataaagcgccgcaccatctgctttaccgcgtattccgcggcatagcgttcgctggtctggagcatttcgccggtgacatcctgcgtatccgtgcagtagccgagcgtgaacccggcaacatattccttatcctgcgctgcggcaaaatctgccgccttggtcgcaccgccgacgaataccggcagaacaccggtcgccatcgggtcgagtgtgccgccgtgaccgatcctgcgcgtgtgcagaataccgcgcagcttggcaaccacatcgtgcgaggtaaagccctgcggcttgttcatcagcagaatgccgttcaggtcactttgctgcatgaaactgctcctctgccgccttcagcatagcagccttggcctccgccatgccgcaggtgaagctcgcacctgccgcacggacatgaccgccgccgccgaccttcttgcagatagcggccgcgtccatctccttggtggtgcggacggaaacgcgaaccgtgccgtccggcttctcggtcagcgtgatgccgatctgtacgccctcaatctggcgcgtaagcgatgcaatcgagtccagatcgtccatatccgcgcctgcatggtcgatatccctgcgccagagcacggcaaccgcgatcgcgccgttctcgtggaactccatcgtatcaaatacaatgcgctccatctcaaaccgcggacgcgatttggtctcaaacagcacgcggttgatctcaccgccgtcgataccggcagtcaggcaggccgccgctaccgcatgcgaatgcgcggtcgtattcgagaacttaaagcagcccgtatcggtcgaaacaccgatataaatgcactctgcaatatcggctgtgaacttaacgccgagcgccgtcagcacatcgtacagcacctcggcacagccgcctgcatccggccggatgaggttttttttgccgaagccgtcgttcgagccgtgatggtcaatgaccaaatcgaccttgcccttgtacggctctgccgtgtccggaaacagcttctcctcagcgatatcggtcgaaactacatacgccggaacgaaatcctccggcggataatacggcacgatcagcggcgcataacgcctggtgatctccggattttccagaatatatgcgcgcttgccaatctgctgcagaccgcggcagagcgcaccggcacagcctgccgtgtcgccgtccggtctgcggtgagtcaggatgagaatgtcgtccgctgcctgcagcgcagcagcagcgccagcaacgtcaacgatcattctgcgtcctcctctcccagcttgccttcatttttcagctcgtgcagcacctcggagatgtgtgcaccgtgggtgatggactgatccagctcaaataccagctccggcgcatagcgcagctgtaccttgtggccaacctcgcggcgcagccagcctgccgcagacttcaggcccttcatcacgtccttggtctgctgctcgctgccgagtacggaaatatagcacttcgcataacgcagatcgttggtaacatcacagtgtaccacggaaaccatagcctcctgtacacgcgggtccttgacagagcgcatcgcctccgccagagccttcatcacttcttcggaaatacgatcaattcgagtagacattttacaaatcaaacctccttcgtgaggattggttaaataatggagaattgagaatggaaaatggagaatgattctccattccactctgcacattccctccggtcgtataggaaaatgcgctatcgcgcattttcacacgcaccgcagtgcgtgattcaattccctataaacatcgagctttgcccgatgtttataccactgcccgtgccgccgcggcacggcctcgtttgccgtgcaaacgagaggggggtatcgaaaaaagtttcctcgggaacttttttcgtatataggggggatggaatcccccctataaggcgttttactgcttcacttcttccataacaaagcactcaatgatatcgccttccttgatatcattgtagttctcgatgctcatgccgcactcataagaggttgcaacttccttcacatcgtccttgaagcgcttgagggtattcaggtgaccctcatggaatacgatgccgtcacggactacgcgaacctcagcgttacgctgaatcttgccgtcctgtacatagcagcctgcaaccgcgcctgcgccggtgatcttgaacacctgacgaacctctgcgtggccgagaacaacttccttgaacttcggctcgagcatgcccttcatggcctgctccatctcctcgatggcatcataaataacgcggtacatacgcatatcaacgccctgctgtgcagcggagtcggtagcggtgcggtccggacgaacgttaaagccaacaatgatcgcgccggaagcggcagccagcataacgtcggactcgttgatggcgccaacagcaccgtggataacgcgcacgcgaacctcgtcgttggtcagcttctcgagagaggaacgaaccgcctcgacagagccctgaacgtctgccttgacgatgatattcagctccttcatctcgccctgctggatggaatcgaacaggttatcgagtgttaccttgtggaacagcttgttgcgctcttccttctccttgtccttgcgctgctcaaccagctcacgagccatcttctcgtcgtctacggcgtcaaagatgtcgcctgcacccggaacctcagccagaccgatgatctcgaccggaacggacgggcctgcggactcaatcttcttgccgtcgtcgttggtcattgcgcgaacgcggccgacagaggtgcccgcgataacggtatcgcctgcatgcagggtgccgttctgtaccagaagggttgcaaccggaccgcggcccttatccagctttgcctcgatgacggtaccgtgcgccttgcggttcgggtttgccttgaggtcagccatttcagcggtcagcagtaccatttcgagcaggttgtcaatgccctgaccgaactttgcggagatgttgcagacgatggtctgaccgccccattcctccggtaccagctcgtactcggtgagctgctggagcacacgatccgggtttgcaccctgcttgtcgatcttatttacggcaacgatgatcggcacgtttgctgccttggcgtggttgatcgcctcgatggtctgcggcataacgccgtcatcggctgctacgaccagaatagcgatatcggttacctgcgcaccgcgtgcacgcatggaggtaaacgcagcgtgacccggggtatcgaggaaggtgatcggcttgccgccaatcttaacgcggtatgcgccgatgtgctgggtaatgccgccggcctcgccctcgatgaccttggtcttgcggatcgcgtcgagcagagaggtcttgccgtggtcaacgtgacccataacaacaacgaccggatcgcgcggctgcagctcttcttccttgtcctcgtgctcatcgaacagctgctcctcgatggtaacgtgtacttccttctcaaccttgcagcccatttcctctgcaacgatggctgcggtatcgtagtcgatcacctcggagatggacgccataacgcccagcttgatgagacccttgataacatccgctgcggtgcgcttcatacgggaagccagctcaccgacggaaatctcctccggaatcattacctttaccggaatcttcttaagtgctgccatctgctgctgacgctgcaggcggcgcatcttctcctgctcctcctgacggcgcttgttgccgaacggcttggagcgctggtcggacttcttggtcagcttctgcttcttgctgcccttggactccattcgctcggcctttgcgtcaaccagcttatctacatgatcatcatattttgcaaggtttacgtcgccggtgccgcgggtatcaatgcggtgaacctgctttaccttgctctgtgtcggctgctgctgcacgataggctcctctctcttggactcggtctgctgtttggtttccgccttggactgctccggcttcttgcgggatgcaccctgtgcgttcagcgtaccttccatgtcacttacttgattatgctgggtgagatactcgaaaatgaccgacaggtcggtatcgtcaagcacctgcatgtgattcttcggtgcagagcgatacttcgtcagaatttcagtgatctccttggtggatacgccgaagtcctttgcgacctcgtgtacccgatatttattgtctaatgccatgggcaataacctccttacacacttcgttcaaaaccacggttttgaacgagagaggacgtaccgaacaatgttcgaatacgtccaaagctgcgaaaagttcctcctgtgtcgagacttttctccgctctggtatcaaatgcacgggcaaagctcgcacatttgatgcaaagctatgctttgctattggaatgcgcgctgcggcgcgggaaattacgttttattgcggaagctgcgcttgccgctgttgaagctcggcttgccggcaccgcttttatggtacgggcggcgttcgccgtccttgcggaacggacgcttatcgccgtcgttcttgcgatacgggtggtcgccttccttacggtacggacgcttctcgccatcgttcttgcgatacggacggtcgccttccttacggtacgggcgcttctcgccgtcgttcttgcgatacggacgggattcgccgtccttgcggaacgggcgcttctcgccgtcgttcttgcgatacgaacggtcgccttccttgcggaacggacgcttctcgccggacggcttacggtaggtgcgcttcagcttctcctctgccgatttttcggtcttgaccggcgcttcctctgtcttttccgccttatccttatgctttttgacgcccctgcgggactggatctttacgttcttttcgctaagctgctgcgccacttcggcgtatgcaggatcctgctccgccagcttatttacggctgctgccgccatgccgatgtccgctaccgcgcacatcgcgcagcctgccttgccgatcgcgctgccgagttccagcttgccgtgcggcagcgttacgcacggcacattggccttatcggcgtaaaatgcggcttttttcgctgcatttgcgcctgcgtcacccgcaatgaacacacagcgggtcttgtggtcgaagcacgcctcgcgcaccagctcgtcgccgtaagccagcttgccggcacggcgtgccagaccgagcattctcagaactggatcagttgccatttgcaccctcctgttccatctgctgctcgagctggtcgtaaaccgactcgggcacctctacactaagcgcgcgctcgatcgcacggctcttgcgggcctttttcagacattccggcttgccgcacagatatgcgccgcggccgggtgccttgcccttgaaatccagcgaaagctcgccttccggcgaacgcaccacgcggatcagctcccgcttcgggaacatttcacggcagccgaggcactgccgcatgggaatcttcttctgtaccatattctgccgcacctccgcttgcttattcgccctgagactcaggagcgatatcgatcttgcagccggtcagcttggcagccagacgcgcgttctggccttccttgccgatagcaagcgacagctgatcgtccggaacgatgacgcggcaggacttgttgtccgcctgcatggtggcattgataacatcagccggagcgagtgccgcggaaacgaactgtgccatatcctcgttccacttgatgatgtcgatcttctcgccgttcagctcgccggtgatgttggcaacacgcgcaccgcgggtaccaacgcatgcaccgatcggatcgacgttctcatcgtgagaaacaacagcgatcttggtgcggttgcctgcctcacgcgcgatggacttgacctcgacgataccggagtgaatttccggtacctccagctcaaacagacgcttaaccagacccgggtgggtgcgggaaacaacgacctgcgggccgcgggtgccgcggcgaacctcgataaggtaaaccttcaggcgctgaccctcagtcagaacctcaccgcgcacctgctcggaagcggccagaacggcctcgctcttctcaccgccggaaacaacatccagataggcggtgccggagcgcggatcgatgcgggcaaccacgccgttcaggatctcgtgctccttgctctcgaactcggagataaccatgccgcgctctgcctcgcggatgccctgaatgataacctgctttgcagtctgggcagcaatgcggccgaaggacttggtcgggatgtcgatatcaatgatatcgcctaccatcggattgttcttgtactcggcagcctcctcgagagtgatctcctcgtacggctcgtacagatcctccgccttgacaaccgtcttgcggacaaacatgtgaatggtcttcttgtcgcggtccggctcaacgtaaacattgtcggtcatgccgtcgttatcgcgcttgtaggcggtgatcagcgcctgacctacacggtcgagcatatagtctaccggaatgcctttttccttttccaactgttccagcgcgtcaaaaaattctgcgttaaccattttttcctattcagctccttcttatatctctaccgccagtcgaactgcggcaatgtctttgggttcgtatacggtctgctcgccgttcacttccagcgttacggcgccgttgtcatagccggcgagtgtgccctcgatctgcttcatgccgttcatcggcttgtaaaagcctacttcgacggtctgacccataaacgcctggaaatgctccggacgcttgaggcggcgcgacatacctgccgaggaaacgcacagcgtataggacggcatatcgtcaaattccttttcatccagcatgggatcaagcgcgcgcgaaacctgctcgcactggtcaatgttgacgccctccggtcgatccacggtgacggtcagcatgtactgtccgccctctttttcaaactccacatcccacagggaaacaccagcctgttcacacaaaggctttaccagttcctctacgcgggctacgatctgctttgcctgcaaagccgtccctccttactgaaaaattttctccgagcaaagcgtaaggagtggcacttggccactccttacggttacttatcatcttacattgatagtatatcacgcattgccgtacattgcaagcgtttttgcaataaaaatatccgtttttaccgtgaaaatgcacaaatttaggcgtgtgagccgcaaattttgcgagttagcggctgctgccgcgtctcagctcgtgcaggatgcacagtcccatggcaaggatgggcagcaggatgcgcagactgaggaagcccatcgggtctccgaagtcgatgtttgcatccagtatcaggccgataaaccagcctaatatggtgagcatggttgctttcaggtacataatctcttcctacctttctatcattagaaactcatatctgcatcaaaagtacgccagttaaacgaatcataaaaaatttcaagatcagacgcatacatgccgctattttctcgagcacttgtctcattctcggcaaaaggagtccatagcttctcgtcagaataatttcgctgattatacatcacggcatagctttttactgcctgttgatacgacttaataaactcattataagtaggcaataattgttcgctcaaaagatgatagcacccattgtcttctgatagtgttttcagcatctctgtatctcggtcaataaacgcctgtgcttctttactcttttcagccggagctgtccaaaaagcattattatttatagctgcacgatatacttcaagttcagtcatacatacagaaatagtgcaatccagtttgtacgctgctataagaatttctgtgaaatcgtcataaactgaaatcgtctgcgtattgcggtcatagccgatatccgcgccgaacgcattcgacaccgcacgaatcggcacataggtcgtgccgttgtagataaacgcctcgaccgctttaccgttggcgtctgtcatgtcgatcgcttcgttgttgaattccacattgacgccggacgtgacggtgatcgtcttgcgataggtgttcgccgcataggatgtggtcagaaacagagcaaacatcaggatgattgcggggattctctttttcatagcgggacctccctttatttgtttgttacagtataccaaacaaatcctgttttttcaacatcatattattcatccagcacaaaagccgtccagcatttctgccgaacggctttgctattccgtttatatctcaaccgactgcacacccgggatatcctcctgcaaccgcagaaatccgctttatcaaaatgccgcggcatggcaatgtacagctcgattttaccgaactgccttcctgccgcttgagatcgatctctcgcacggtgattttcctctgctccagccagtcgtacagacgcacaagatcgcctttgccgtctgtcagaccggccacgccgccgcggtgcacgaaaatcacgcccgcgccaaggaagccgataccggccgcaatgcttgcgccacacgagaaacgtcaaccgaaacaccggctgctcccacgataggcagaaaaccatacaaggagaccagcgtcatcagtgccgcaccgaacgaaactatcatgtgtacgcggaccggcgcctttcatgcgtgtctgccgctccacaccgatcagcagaccgcagacagccgcaacgatcagccgcaccagacagatcatttgaatattttccggcatacgcaagccccctgccgaataaaaactatcgctcaaacgacagataccgcgtcccctggaaggtcagtctgccggtgtcgccctctgcgagcataccgtattccaagctggaaacatggaattccatccggtctccgctttctacctgaaacgtgacataataggtcgtgctcgatgttgtgtggaagccgtgcgctccgctcatgtcgcctgcattggcatgacggtgatacgagacatctgtccgctttgcaacgatcaccgccggtacggtcaatctgggcgaattattgttcttatgccatgtacttatcccctgtatgatggaaaaaatgatgataccaaatacaacaataaacatgatggggacgatgaaactcaatatatcaaacattgcaaacatctttcagccctccttcaacgttccaattttcgatcagacaatttacgttctacctacatagtatcataggtattccaaaaaggcaaaaagaaaaaggttatccaataagcacgctactggataacctttttaggatcatttttctgttttggaacagatcgagtcgtcagaagttaaaatataacttacttaaccagctcgatgatcgccatttcagctgcgtcgccacgacgcgggccggtcttgatgatgcgggtgtagccaccgttgcggttagcgtactccggagcgatctcagagaacagcttagcaacaacagcttccttggttacgaaagccatagcctgacggcgggatgccagggtgttcttcttgcccagggtgatcatcttctcagtcagcgggcctacttccttggcacgagcgagcgtggtctcaaccttgccgttctccagcaggtaggttaccagcgcacgcagcatagccatacggtgatccgtagcacggccgagcttgcgattgttagccatgtgagtttacctccaaattaaagtaaagcggcggcgcggtaatcgtaccgccgcagcagttcaagttacagtgtccgaagattactcttccgacttcgccaagtggagacccattgcctccagcttgccgataacctcttccagggacttgcggcccaggttacgaaccttcatcatgtcctcctcggaggtgttgatgaggtcctcaaccgtgttgatgcctgcgcgcttgaggcagttgaacgaacgcacggagaagtcaagctcctcaatggtcatttcaagcaccttatcgtgctgcgcttcagccttttcaacaacggtggacttggagccgatttcctcggacaggtctacgaacagatcgaggtggtcgcgcagaacctttgcaccgagcgaaaccgcgtcgcgtgcgttgatggttgcatcggtccatacctcgagcgtcagcttgtcatagtcggtcaggtcgcgtacacgggtgttttcaaccgtgtagtttaccttgtaaaccggcgtgtagatcgaatccaccggaatgacgccgatggaggtctgatgctgcttgttcttctcagccggaacatagccgcggccggaagtcatcgtgatctccatggacagacgcgcgtcgctcatcagggtagcgatgtgcagatccgggttgaggatctcaacctcgccgtctgcgtggatatcgccagccttgacctcgccctcgccggcggcctcgatgtagaccgtcttgggaccatcacaatgcagcttggcaataatgcccttaacattcagcacgatttcggtaacgtcttccttaacgcccggaatcgtagaaaactcgtgctgcacaccagcgatcttgatgctggacgctgccgtgccaggcagagacgacagcaggatgcggcgcagagagttgcccagcgtggtgccgtagccgcgctcaagaggctctacgacgaacttgccgtaggaaccgtcctccgcgagctgttcacagtcaatacgcggtttttcgatttcgatcatgtggtaccctccttcacgttggttggaaacttaagatagaacaggcgaagcagacgccgcgcctgttccaaaagcgagggtctattatttcgagtacagctcgacgatgaggtgctcggcaacatcatagtcgatgtcgtcgcgtgcaggcatcgcaacgatcttgccctcgaaggaatcgttagccttctcgatccacttcgggcaagccttcttgccgttctcttccagcagagacttgaacttggtggtagaacgggacttctcggaaactgcaactacgtcgcccggcttaacctggtaagacggaatgttaacgcgcttgccgtttacggtgaagtgtgcatggttaaccagctgacgagcctcacggcgggtgttagcaaagcccatgcggaaaactacgttgtccagacggcgctcgagctcctgcagcaggatctcaccggtgatgccctgcttgcgctcagccttctcgtagtaagcatggaactgcttctcgagtacgccgtagatgaattttaccttctgcttttcgttcagctgcatgccgtactcggactgcttgcggcggctctgcttgggctgacgcttcgtggacttggagtaaccaagtaccgcaggggaaagaccaagcgtcttgcagcgcttgagaacgggctgggtattcttagccatttattggttcctcctctattaaactcgacgacgcttgggcggacggcagccgttgtgcgggatcggggttacgtccttgatcatggtaacctcgaggccagcggcctgcagtgcacggattgcagcctcacggccggaacccgggcccttaacgtatacttcaacagtcttcagaccgtgctccattgcagcagcagcagcggtttcagccgcagtctgagcagcgaacggagtggacttacgcgaaccgcggaagcccatttcgccggaggaagcccaggaaatagcgttaccgttcaggtcggtaatggtaacgatcgtgttgttgaaagaggaacggatatgtgccgcgcccttttcaatgttcttgcgctcacgacgacgagtacgggtcgcagcgcccttcttctgtaccttagccatttatacgttcccctccttacttcttcttgttcgcaatggtcttcttcgggcccttgcgggtacgagcattggtcttggtgcgctgaccgcgaaccggcaggccgcggcgatggcgcaggccgcggtagcagccaatctcaaccagacgcttgatattcaggccgatctcacggcgcaggtcaccctcgacgttgtagtcgcgctcgatgacttcacgcagcttagcagcctcttcttcggtcaggtccttaacgcgggtatccggattgataccggtcttagcaaggatctcgttggacgttttgcggccaatgccgaaaacgtaggtcaggccgatctccacgcgcttctcgcggggaaggtcaacaccggcaatacgtgccatactattataacctccatagttacacactgaggcgtgtttgcaaacacagtataggagccgcctccgctcctgcagcgccgcactcgccgtgcgtgcttgtcgtgctcgcgtaaaccatgatccgcacccctgggtgcgcatttattgatgactgcaagcagtcatcataaaaacccgcgacatgtgcgtgggtttttataccttgactcagcgatcttggatcgcgtcgttcgggtatcaaaaacaagtttcgtcaggaacttgtttttgtacataggggacttttgaagtcccctataaagcgccacaggcgcttcttagccctgcttctgcttgtgcttcgggttctggcagataaccataaccttgcccttacggcgaatgatcttgcacttctcgcagatcggctttacagacggtcttaccttcatgttattttacctccatcaaatttttggtgggatgggacaccggaaacctgtccggcgaccactggcgcgcaggtcacatgcgtacctccgcccgctttttatcttacttggaacgccaagtgatacgaccgcgggtcaggtcgtaaggcgacatctgaacggtgaccttgtcgccgggaagaatgcggataaagttcatgcggagcttgcccgagatatgcgccagaatcttatggccgttgggaagctctacctgaaacattgcattgggcagcgcctctacgacggtaccctcgagctcaatcacatcatcttttgccattgtggtttatcctcctcggtcaatttgcgttctcgtcccctgtccagagggcgagcgccttgcggatctcgctgtttgtcagccggctttcgctttgcagcttaagccgtgtgcgctcgtcgcatgggccctgcaggctcacatgcttgcggcgcttgcgcttcgggttttcggcccggcgcgcacgtccgttcgccagcagaagaaaatccccctcttctgcgacgaccagcatcagctgtcctctgtcccttccggtcagcgacagcacaatgtcggcggtacgaatctctgccattacagcacttcgccgtcgatattcgtaagaatctccggctctccatccgtaatagcgatggtgttttcgtagtgagcggacagcttgccgtccctggtcttaaccgtccagccatccggcaggaccttgaccgtgtaaacacccacattgaccatcggctctaccgcgatgaccataccgcgctgcaggcgaatgccgtggcccggtttgccgtagttcggaacctccgggctctcgtgcagcgcagcgcctacgccgtgaccgacgtagtcgcgcacgacagaaaagccgttggcctcgacgtaagcctgaacggctgcgccgatatccgatacgcggtagccctcacgggcaaatttaatgccttcaaagaagctctgacgtgttacagcgatcagcttttttgcctcttcgcttacctcaccgcacggaaccgtgcaggcgcagtcgccgtggaaaccgccgatgtatgcaccaacatcaaccttaacgatatcgccttccttgacaactgcatgcttggaaggaataccgtggatgacctggtcattcagcgatacgcaggcgctgcccgggaagccgccgtagccgaggaaggacggcttggcgccagcatcctcaatcgtcttgcggacgatgcggtcgatctcccaggtggtaacacccggctttacggcgtctgccgccgccttacgcgcaatagcggtaaggcggccggcaacacgcattttttcaagctctttttccgtcttgatatgaatcatattacagacccagcgcctctactgcaaacttttcggtagcggtgatgccctgtgcaccatcgatgctcttgagcttgccctgggcttcatagtagcccttgagcggctcagtctgctcatggtaggtttcaagacgatgacgaacgacctcagcctgatcatcgctgcggatgaccagcttatcgccgcagatgtcgcaaacgtccttcacgcgcggcggatttgcctcaacgtgataggttgcaccgcagcgcaggcagacacggcggccggtcatgcgcttttcgatgacgtcgtctgcaacctcaagggacagagcgcagtcgatgtgagcaatctcgtcgagtgcttccgcctgcggaatcgtacgcggaaaaccatcgaggatgaaaccgctcttgcagtcgcgcttagcgatacgctccttcagcatgccgataaccacttcatcaggtaccagcttgccggcatccatatactccttagcggactggccgagcggagtattgttcttaatcgcttcgcgcaggatgttaccggtggaaatgctcggtacacccatctgctcgatcaggtaagaagcaagcgtgcccttaccggcgcccggagcgcccagcagaattaaattcatttgaacacagcctccagaattattccaggaatcccttatgatgacgcatcagcatctgtgcttccatctgcttcaccgtatcaagcgcaacgcctactacgatgataaccgaggtgccgcccagtgctacgtttctcaggctggagtttactgcgcctacgatcagcgggagcagtgctacaacagcgaggaacagcgcaccaacgaaggtgaccttgccgagtgccttggtgatgaagtcgctggtcggcttgccgggacggaagcccgggatgaagccgccgttcttcttcaggttgttggcgatctcgatcgggttgaactggatggatgcatagaagtatgcaaatgcgaggatcagcagtgcgtacagtacaatgtagaacacgctggtctgagagaacaggttaagaatgtgcgcaccaaccgagccgctctccggctgccagaacatcgaaatggtctgcggcagggacaggatggacgatgcgaagatgatcggcataacgccggacgcattgaccttgatcggcaggtgggtggactgaccgccgtacatcttgcggccaactacgcgctttgcgtactgaaccgggatgcggcgctctgcgttcgacatataaacgatgaatacaacgatcgcaagaccgacgataatcattacaatgccggaaacgatgccgctcgtgccggtctggaacaggttagccagcgtacgcatgagcgacggaccgcgggaaacgatacctgcgaacaggatgatcgaaatgccgttgccgatacccttctgggtgatgtgctcacccatccacatgatcagcgcggtgcctgcggtgaaagttacgataatggttacggctgcaagcgcgccggtgttggacagcatagtcttgccgccgaaaccgttgcggagcagtgcgtagtaggacagaccctgaagcagaccgagcagaacgccgaggtaacgggtccagcttgcaatcttctcacggccttcctcgccgccgtcctttaccatgcgctcaagagcggggatggcaacagtcagcagctgaaggatgatggatgcgttgatatacggggtgatggacattgcgaagatggtcgcacgagacagaccaccgccggtgaacatatccagataaccaagcatcgaaccgtttaccgatgcctgctcaaagtactgagacaggagcgtggtatcaataaacggaaccggaatgcacgaaccaaagcggaagatcaggatgatgaacagagtgtacagcatcttcttgcgcagttcgggcatagaccaggcgtttttaagggtttgaaacaccttaaaccacctcggcctttccgcctgcggcttcgatcttctcctttgcggaagccgagaaagcagctgccttaacggtcagcttcttggtcagcgtgccggtgccgaggatcttgatgccgtcgagagcattcttaacgatgccggcattgcagaggatctctgcagttacctcagcgccgtcttcaaacttctccagtgcggaaacattgaccggtgcgtaagtggtgccgaaaatgttgtggaaaccacgcttcggcagacgacgtgccagaggcatctggccgccttcaaagcccggacggacaccgccgccggaacgggcccactggcccttgtgaccgcgacctgcggtcttgccattgccggaaccagcgccgcggcccttacggtatgccggcttggtagcgcctgcggcaggcgtcaattcatgcagcttcatgggttacgcctcctctacgatttcgagcaggtaaccgatctgctttaccttgccgcgcgtctgcgcgttgtccggctgaacggttacgtcattgatcttcttaagccccaaagaatgagccgttgcgatgtgcttctccaagcgaccagccaggctctttttcagggtaatcttcatgttagccattgtcagttacccctttcttacagttcttctacggctttgccgcgtacagcagctacctgagctgcgtcgcgcaggctcttcaggccttccatcgttgcggtaacaacgttctgcgggttgttggaacgcaggcacttggtacggatgtccttgatgccggcagcctcaactactgcacgaacagcgccgccggcgataacgccggtaccgggagccgcaggcttgagcagaacgcggcctgcaccgaactcgccgataacctcgtgcgggatggtggtgcccttcagagaaatcttaacgaggttcttcttggcgtcctcgatgcccttgcggatagcgtccggaacctcggaagccttaccgaggccgaaaccaacggtacccttgccgtcgcctactacgaccagagctgcgaacttgaagattcggccgcccttaacggtcttggcaacgcggttcagcgctacgacgttctcggagaactcgtcctcacgcttatcgtttctgttaaactgagccatgttttacctcctcccgattaaaactgcaggccgccctcacgggcgccatctgcgagctccttcacgcggccgtggaacacatagccgccgcggtcaaacacgacagcctcaatgcccttagccttgcagcgctcggcaacgatctgaccaatcttcttggctgcttccttgttgccgccgtactcggtaaagctcttctctgcagtcgaggcggatacgagggttacaccggctacatcgtcaataacctgtgcatagatgttctttgcagaacggaatacgtccagacggggacgctcagcggtgccgctgatcttagcgcgtacgcgcttgtggcgctgaaggcgcgccttgttggaatccttcttcgaaaccatttattttcgcctctcctttccttacttcttcttagcgccggtcttgccttccttgcggcggacatactcatcagcgtagcgaatgcccttgcccttatagggttccggcggacgcttctcgcggacttccgctgcaaactggccaaccttctgcttgtcaggaccggagatgatgatcgtgttcgggttcggaacgtcgatcgtgatgccctctacctcgctcatggtaacctgatgcgagtaaccgaggttcataaccagatccttgccctgcttagcgacacggtaaccaacgccctgaacgctcagctccttcttgaagccatcggtaacaccaacaaccatgttgtgaaccaggctgcgggtgaggccgtgcagtgcgcggttgtgcttgtcgtcgttcggacgggttacgaggatttcgttgccctctaccgcgatggtcatgttcggatgaaattcgcgggtaagggttgccttagcgcccttcacggtaacaacgctgccgtcaatcttgacttcaacgccggccgggatggcaatcggcattctaccaatacgagacattgtttatacctcccttaccatacaaatgcgagaacttcaccgccgacattcagctcgcgagccttcttgtcggtcatgacgcctctggaagtggaaacgatggcaataccaaggccgcggagtaccttcggcagctcctgtgcgccagcgtatacacgcaggcccggcttggacacacgcttgatgccggtgatagccttctggcggttatcaacgtacttcagtgcgatgcggataatgccctgggtgttgccctctacaacctcgaaagacttgatgtagccttcatcgagcaggatctgggcaatagccttcttcatcttggatgcgggtacatccacactggcatgacgagcattgccagcgttgcggatacgagtcagcatatccgcgataggatcagtgatctgcataaaatgctctcctttaatataagaagtttgggggtagtgcagcaatcgagcgccggtgggttaatccggttctgatttgtctgtttgccctccacttttctttacactgttcgtggcccttccacggacagcggcggggataaaaaatcgccggtccagtactcaaccagaccagcgttaattatagcacgagaaaccaatggctgcaatcggaaaaagtgctgatttttacgcagtttcagcctgttttgcagtcaaattgcttgattacccggtataacggcaggtcggccgtttttggaccgcaccagggaccacgccgggaaaatccggttgatggccgatgggcgtgcgcgggagaaactcctttgcgcggcaattcggttacgcatttgcgcaactgtaattagtatacactacaccgggtgtatcgcgcaagtgtttttttcaaaatttcttatttttttgagatttctttttcgatgggatttcgcctgcgaggcgaacggaacttgcctgcccggcaggggcacaagaaggagagaaccaaggttccctccttcttgtgaatcatccttcttcctatttagcacggcgaaatttgcagagctgagactataaaggaacggcagaggatcttttcttccgcatggtcgcacttcgtgcgccatgtatccgcatatccgcagtgtcagataccattctgccacacagaccagaaaatctacgctgggtgcggcacaaggtgaattgcccgcagggcaagagagggtcccctggaggataacagtgccgcacaattcgtgagcgcgttgtttgttacagacagggcctgcgaaaataacttgtaccaaacgcctaatccgtaggtgccgtgcgtaaactccagattaacgaattgcgcaacacggtcatgttgcgcctgcgtagatctaaccgcatgtgtagcagtacgttatctgacactgcgaatcggttgagaaagacacggaagaaaaaatcctctgtcgtactcttattttcgaagcggtcgccgctctccgattttcgccgagttaagaaataaaggaaactggagtcccaagaggatagaaaccttggtgtctatccttttggaaccccagctaagagttagcacccaatcatcattctttaggaaaccgcaaagtaatgcaagtcccctcgccgagcgcactcttcagctcaacctccgcatgatgcagcgccgcaccatgcttgacaatcgaaagccccagtccggtgccgccggtcatcttgctgtggcttttatccacgcggtagaaccgctcaaacacgcgctgctgatccgccggcgcgataccgatgccggtatccgacacctgcacgaacggccgcccgctctccgtgccggtcgtaagcgtcacgctgccctgcggcttattataattgatggcgttatccgtcagattgaagatcatctgctcgagcgtgcggcgctgaccagaaaccgcagccggttctccctcgatgcgcagcgcgatgcccttgcctgctgccttgctctgcagacggtcgcgcacggtatcacaaagggcggacagctccaccggctcaaaagccactgtttctccgccttcatccagccgggacaggtgaatgatatcctcgatgagcgccagcagccgctgcgcttccgtgcggatcttgcccgcaaacggcgccacgtcctccggcttggcaatgccgcccgcgatgatttccgcgtaacccatgatgctggtcagcggcgttttcagttcgtgcgacacattggctgtaaattcctgccgctgctgctcggcacgctcgcgctcggtaatatccacgatcagcagcacagcagcatgccatgcgctgttctcctccaccgagcttgccgtaagttcataaatgcggccgttccgctcaagtttgccgtgcgcgcctttgccgtcgagcgcctgctcgaccacctgaatgtaattcgcgtcgcggcacagcgtcagataactgccttccgcactgtcatgcgggaacagcgcccgcgcagcgtgattggcgaacagaatcatgcccttgccggaaaacagtaccagaccttcatccatccgagccgtaatgtcgtcaaactcagcctgacggcgctgcagctcgtccatctgcgcctgaattttgcggttctgcttgtccatgcggtgcagcagcggcgacagctcgtcataggcttcgcccttcatcggctcatgcaggtcgagtgcttcgatcggcttgaggaacagaccggtcagccagcctgccagcagcgccgcgaccagcagcgccagcaggatgatcagcacaatccacggcgatgcgctcgacagtgcgccgaacacgctgtccgcagttgcagaaatacgcagaacatcgccgtttttcaggcgcaccgcgtaataaaacgtctgcttagcgaaggtttcggacagacggttgtcttcgcccgtgccgttcttctctgccgccgcaatctccggacggacggcgtggttctccatctcggaggcattcgtgcggttatcgtacagcaccgtgccgtcctgcgcgaccagcgtcaaacggtcggcatacaccgagccgaacttctccagttcctcccggatgttatccaccgcagacaggtagctgctctccgtcaccagccgctgccgcatgtcattggtcagaccggcgtgaactgccagcagcagcagcccggtcgtcagcagcagcgtgacaagcgatgtgaggaaaatgctgccgaatacgcgctttctcatgtatgctctcccatgcggtagccgacaccgcggacagtctcgatcagcgcaccgtccgcgcccagcttttgccgcagcgtgcggatatgcacatcgaccgtgcgggtttcgctttcattattatagccccagatattctcgagcagcacatcgcgcgtgagcacggcaccgcggtttttcatcagcaggcacagcagctggtactccttgagcgtcagctgcacctcctgctcgttaacgaatacggtgtgagcacgctcatccacacagatgccgccggctaccagcggacgcgactcatccttgtcctgcatatcctcggtgcggcgcaggaccgcacgaatgcgcgcgatcagctccatcatgccgaacggcttgggaatgtaatcgtccgcaccggtgtccagaccgactaccttgtcgtactccgtatttttcgcggtcagcagaatgaccggaatcttcgccgtgtccggcgctgcgcgcagacgacgcagaatggtgatgccgtcctcaccgggcagcatgatatccagcagaatcagctgcggcctgcgttttttcagagcagcggtcagcgccgcaccgtcctcgaagccgtcagcctcaaaaccggtgttgcgcagtgtgtacaccaccagttcgcggatacccgcatcatcttccacacagtatatcatatgttacactccgatttctgtcagcgcgccgccgcttccgcgccgtgcattgcgcttttatgcgagccggtgatggaaaactccacccattcggcaatattggtcgcgtggtcgccgatacgctccagatacttggcgatcatcagcacatcgagtacgcgctcgccgtcctccgggttctgcgcgatctccgcgatgaggtcgctcttgcactcgtcgaacaggcggtctaccacgtcatcatattcaataacgctccatgcaagggtcaggtcacggcggacaaacgcatccaggctgtcggtcaccattttaatggttgcctgtgccatctggtcgatatgcgtgttgtgaccgcacgcaccggacagatacgttacaatctccgcaatatcgcttgcctggtcaccgatacgctcgatatccgtgatcattttcagcacagacgagatcagacgcagatcgcttgcaaccggctgctgctgcagcagcagcttgaggcacatggactcgatttcgcgttccttgcggtcgatctcctgatcaatgcggatggcggcagccgccagcctgatatcgccctcaagcagggcctttaccgcactggcgattgcgttttcgcacagtgcccccatcgagatcagctcattgttcatctccgcaagctgattgtcaaaacggtttctcattagccgaacctccccgtaatgtagtcttccgtgcgcttgtccgacggcatggagaacagcttttcggtgtcatccacttcgatcatgtcgccaagcaggaagaacgcagtcgtatccgaaacacgggtggcctgctgcatattatgcgttaccataacgatagtataatcctttttgagttcgagcacaaggtcctcgatcttcgcggtggagatcggatcaagcgcagaggtcggctcgtccatcagcagcacctccgggtctgcggcaagcgcacgcgcgatgcagatacgctgctgctggccgcccgacatggacagcgcggattttttgaggttatccttggtctcctcccagatagcggcacgcttgagcgaggtttcaacgatctcgtcaagctgcacacggctcttgatgccgtgcgtgcgcggaccgtaggcgatgttatcataaatcgacatcgggaacgggttcggcttctggaataccatgccgacacggcggcgcagcagattgacgtcacagttcttgtagatatcccgaccatcgagcatgatgtcgcccgtgatacggcagttttccaccagatcgttcatgcggttgagcgaacgcagcagcgtagacttgccgcagccggacggtccgatgaatgcggtgatctcattctccttgatatccagattgatatcgtgcagggcgtgaaaatcgccgtaatgcagattcatattgtgaatttcgatcttattttccatgttcattctccatttacttcttggtcagctttttcgctgccagagcggaaagcgtattcatcagcaggaccaccagcagcagaacgactgcggtagcatttgcctcgttcatgtgcagcgcctcacccgagagcacatacatgtggatggccagcgtacggccggactggaacagaccgggaatctgtgccatggtgcctgcggtaaagatgagcgccgcggtctcaccgacgatgcgtccgataccgaggataacaccggacaggatgccgggacccgcagcaggcagcacgatgcggaataccgtgcgcagacgtccggcgcccagaccgaacgagccttcgcggtaggaatccggaaccgccatcagtgcttcctcagcggtacgcatgatgagcggcaggatcatgattgccagcgtcatcgcaccggccagcagcgagtatccccagtgcagcctggtgacgaaaaacagcatgccgaacaggccgtatacgatggacggaatgccggaaagcgtctcggtcgtgatgcggatgacgtttaccagcttgtttccgcgcttggcatactcattcaggtacacagcagtgaacaggccgagcggcacggccagcagcagtgccagcgcggtcgtttcaaccgtagtgaggatagcaggcatcatcgagacgttctcagaggtataattccactggaacagtgacggcttgagatgcgggatgcccgtcaccaggatatagccgatcaggaacagcagcaccgcaaaggtcagcacagccgcgccgtacaccagacccttgagcacagccgcagacgcggtgccgtgcaccttttcggtctttgcctgtgcgcgcactgccggttttgcagcagagacagcttctcttgtcatgcttccttcctccttttgagaaccgagaatgccagattgatgagcagaatgaatacgaacagtacaacgccggtcgcaataagtgcctcacggtgcaggccggtggcgtagcccatctcaagcacgatgtttgccgtcatggtgcggatgcccttgagcatgctgccggtcagtcgcggctggttgcccgctaccatgataaccgccatggtctcgccgatggcgcggccgatgccgagcacgatgccggccagcacgccggacttggcagccggtaccataaccgtgaatatcgcgcgctcatgccgtgcgcccatggcgacggcgccctcgtagtagctcatcggaaccgcacgcagcgccgcttcggacacgccgataatggtcggcagaatcataatgccgagcaggatggacgccgccagaatggacgagccagaaatatccgctccgaacacacctgccaccgcacgaactgccggtacgataatgaccatgccgaagaagccgtatacgatggacggaataccggccagcagttcggtgcacggcttgagcagaccgtacagctttttcggacagtagaatgccatgaataccgccgtcagcagaccgatcggcacgccgataacgatcgcaccggcggtgatgtacaggctgccgaggatcatcggcaggatgccgtaaatgtcgttgcccggcttccactttgcgccggtgaggaagtccagcaggccaatctccctcatggcaggcacaccgttcgcaaacaggaaaatacagatgagcaccaccgcgaagatggaggtcagtgcacagagaaaaaataccatgtgcatcaggttttcccgaaagtttttcataaatctttctcctatacaggcacagggcgaatcgcttcgccctgtttcatcagtctgtgaattcgcttacgcgaggtcgccccagtcagtgatgtcgccgacatagatacccttgatctgatccatagacaggtcgtcaatggtgttcgccgggtttacgactactgcgatgccgtcaagtgcgatggcggtgccggtcagctgtgcagcctcgtcgtccttcagctcgcgggatgccatgccgatagcaaaggtgccgtccatcgtgccggtcatgccggaggtggagtcagaggtctgcaggtcaatgcttgcgttcgggtttacagccttgtacgcctcgatcagcttctccataaccggggataccgaggaggaaccgccaactgcaatctggccggaggagccatccgaagtaaaggctgctgcattgtcgtcaacagcgatgtacttgttatcggttacaacagcctgaccttccttggagaggatgaagttgatgaaatccttggctacgccggtcggctcgcccttggttgcaatgttgaacggacgggacagcttgtaggtgcctgcctttacgttatctacggtagcttctgcgccgtctaccttgacagccttaacagtgtcattcagcgcgccgagcgagatgtagccgatagccttctcgttgcctgctacgctggtcagtacaacatcggtcttgttggcgatctcggcatccgcggtggtattgtcgatcttctcgcctgcgtcgttcttctcctcaacgccggtcaattcgatgaacgcgccgcgcgtaccggaaccatcctcacgggagataacggtgatcgcgccggatacgccgctgtcattgccgcttgcctgggaatccgaagaatcggaagaggaactgccgccgcagccgctcagtgcaccggtcagcatcattgctgccagaagcatggaaatgctctttttcataattagttctccttttacattcgtcttcgttttttgttacaagattatcttacggaagttttgtaaaatgcaaaagcgagagttcgttaagtttaagtaaagtgtgttttttcaggtaaaatctttgttaaatacggattttcgcctgcgattcagcgggagttgcgctctgcggagcgcaggaacgtgcggcacccgccgcaggggcaaaaaggaagggacacctgcggtttgcccgtaggctgctaaacattgttcccgcgccgtgcgcggattaaatgagtgcccttcctctttgaactcctgcctttcccttattagaaagtctggcgcagattgccgatatgtgaccgctctgaaataggggaacggcagaggattttttcttccgtgtctttcgcaacctgttcgcagtgtcagatacattactgctacacagaccggaaagtcttcgcaggcgtggcacaaggtgaattgcccaaagggcaagagagggtcccctgggggatagcagtgccgcgcaattcgttagcgcgttatgatagacagcacctacgaagataaattataccaaacgcctaaattcgcaggtgccttccggtataacgcgcaaaaaaattgcgcggcactatcatgccgcgccttgcgcagagtagcccgtatgtgtagcagtacgctatctgtgaactgcgaatattttacgaaacaaacgcaagagtatcccgactgccgttcccctatttctgagcggtcacatatcggcaatctgcgccagactctcccaaaaggaagcgggagttaagagggtagaaaccttggtgtctaccctcttgccccgccgcgggggcggcgaatccccgcgctccgcagagcgcaactctccgctgagattcagcaaaaaaactgccgcccggacagggtgaaccgcccgcgcggttcaagtaccccgctgggtcggtgcagaaaaggagccgcccgttaagggcgaacacgctaacgcagttcgtatgccccgccgcgtcagtgccgagaaaaaaagagaaccctctcacgaaggttctctaaaaaatcaggtttttcgttttcggaagtacccgaggtacataaccgctgccgccatgctccagaaatacgccatcatatacggcacctcgaagatattctcgaagtagcagtgcaccagcacgccgcacatgcctgcgaacatggaaaccgccagcacgcgcgtgcggtcgcccttggtgtagccggtacggccgatcgagcgcaggctccacagcaccagaccgaacagcagcaggatgaagaacgccagaccgagataacccatctcgaccagcgttttcagataatagttatccatgtagaagtaggagaaatccttggtctcctcgatgaccttgttctgcatggcaaccgcgccgccgaagcggccgagtccgaagccgagcaccggattgctctcctgcagcagcttgagacccttggaccagcgaatgacacggcctgcgcggcggcttgctgcaaggtaatctgcagtaaacagataggtaatgcggttcgcaatagacgggattgccagcagtgcaccgacaccggccacacccatcagcgcgatcaggcggcggtccagaaagatggcgaaaatcacaacggctactgccagaccgccccaggcacccttggaaaaggtgaaaatgcagctcaggcacatcatgccggtcgcgcagacggccagcaccttgacccacattttactgctgtaatatgcaagtcctgccaccagcggggcaaacagcaccagcaggctgcccatgatattcgggctgccggtgagcgagtacacgcgcgtacgcacgctggcctcggtctgagagacccagctcgacgggatcggtgcggctacgatatactggtaaatgccgtgcgccgcaatacagagcgccatcacgacgagcgcaccgtagaataccgcgaaatcgcggtcgttttcaatcaggcgggtgacgaggaagaaccagaacaggtactccacaaccgcacggtagcctgctaccgcgatatgcgtattcggcgaaaccgcacacatcaggaaaaagccgaccgcgatgaacagcagcagataggcatccaccggcgtagcacgcgagccgagcggcgcacgcttcatcgccatgtgccacaggatgtacgcaaatgcagcaagcatcagacactcatcccacacggacgccacaaacgacggcagatagccggcatccgacacccagcggacagcggaatcaagcggcagatacatcgccagacaaatgagcagcaggccgcgcatgccgacgaacctgcaggctctgccgatcaggccgccgcctgcgacacgctcaatcggccgccagacagcaaggcagatgcggtagatcaggctgtttgccgcaattccgcccagtttttcgacaaaccggcgcagcgctgccagaatccgcgcatagatgctgttcgccgaggtacatatcggtgccgcgcagaatttattccacagacggcagaataccgagtctgggtacgcctgccggatacggttaaaaaatcccgcgatagcgccctcgtggtaccatgcgcgcagacacatcagcagccgcacgaacagactgttttcaaataacgctttcataggctttaattatccgcaatatcgaccgaatcaatgttgccggtcgtctcaaaatcgttggtctttacaatgaatgtacggcctgcgcgcacctcctgcgtaccgatggccggtgcaggcgtgcccttggaaaccttggtcgtgatggtgaataccagatccttcttcgccggatcggttgccgttacaatgcggccgtcagcggtggttacctgctgatcgtaattctcgatcttcatgtcggtgatctgcgcattgacatagctgttgccgtttaccagcgacttgcctacctggctgttgcgctgcacctcgtttaccaggaacggcgttgcaccgcgtacgcggacggtcatcgtcagggagacctgcggagacgcaacctccttgatctgcttggcaaacagcttgtagccgacaccggctacgacagcgatcgcagcgaccagcaccagcagatcgacaacattgatgatgccgaacagcttgcccttttcgttaatgatcttcataaatttcctccgttggcaaatgaatttcgtgtttcactgtgtcattataccataggaagcgttaaaagttaagtgttatctttgtgtctcagcaaatcgacaaggaaagaacggaattcgattttctcaccgtttcccgcgtcctttcctgccgcctcctcgcaggtgatggaaaacgccgtacaccaccatgccgcgcgcggactatgcggcgcaaacgccgaccagaacagcacacaaaccgctgtcagcactgccgcgagcacctttctatcctgtttctgcataacaaaaccgcctttctgcatccggtgtacccagtatgcccgaaagacggctttctataccaatttaattgtaggtttccgtcaggaacgtatccgcgaaacggcggcgcagcattttcgctgccgttttggcgcggctctcatccgagaacaggccgtatacggtcggaccggagccgctcatcagcgtaccgtccgcaccgttttctgcgagaaacgacttgatttcgccgatctgacggcgttttgccgccgtaacggtctccatcacgttggacagatacgcgcacacgccctcgtaatctccctgattgagtgcggccatcatgcccttgttgtccggatgctcgaggatatccacgctgtcgatctcctgatagacctccttggtcggcaccgcaaacggcggcttgcacagcacgacccagcagtgcggcatatcgggcagcaggctcagctcctcaccgatgccctgcgccagcatggtgccgccgcgcaggcagaacggcacatcggcacccagtttaagtcccatctcgcacagctcgtcatcggtcagaccggctgtatgcaatgcgttgagcgcacgcagcacagctgctgcatccgtcgagccgcccgccagacctgccgcaaccggaatgcgcttttcgatgtgaatctcgcaggtttcgagcagtgcgccggtctccttatagaacagctctgctgcgcggtacgccagattgcgctcgtcggtcggcagaaacggcaggctgcagctcagcacgatgccgcgcggctttttctcgccgtggatggtggtaacgcgcacggtatcgtgcagcgcgatcgactgcatgaccatctccaccgtgtggtagccgtcctcccgccgtccggtgacgtcgagcgtcaagttgatctttgcacgggcacgaacagtcgtatccgcgtgtgtaatttcctgttttcttccaaaaagcatgttgtttcagcctctacatttatttcagtgcgatctgcactggtttgcgctcacggaacacggtaacgtgggtaaagcctgcgtcgagtgcattcttcacgcagtcgtctacgccgcgtgccacggtgtccagcatgtgcgaatccgagccgatcgagatgcgctcgccgcccatgcgcttgtattcgtacagaatattctgcggtggaccgacctttttctgccagcccgcaataccggcagcattcagctcgagtgcatagccgtggtcgatgcacgagcgcagcacctgttggacgcgatccatgtaattgtcaaacgacgggatatagtcgccgtgcttcatcacgcgcagcggatagtcaatgtgcgccagcacgtcaaagccgccgtgctcctcgagcagcagcagttgatcgaaatactcgtgcaggaacttgtcgcagtccatattcggaaagtcgtgaaagtagatatccagatcgttcggcatggcatgcagcgagccgatgaccatatcgaacggatgcgtgcggacaaaatcgtccgcatccgatgtggcgtgcagctggccgatctccatacccgccagaacctcaatgccgccgtttccggccggacggcgcttttcccaagcctcgcgcgcacaggctttcggatcacggttgtcgcgcgtgccgcccgaacgcagaaaatccagatgatcggtaatgccgatgatatccagtccggcctgctcgcaggcgtgaattttatcgtcgatggactgcggatactgggcgtcagccgaatacccggtgtgcatatgcaggtctacccgcatggacgttcctccttatagataattgaatacggtctgtacaaagcaggcgacgatcagcagaaacatgcctgcattctgtaaaacagccttaagcgacggcgcacagggtccatgcagccagacctgctgttttctgccgcgaacgagcaggatcatgccgatcaccagcatcgccatccagaacaggccgagcgccgactgcgcggctatggtatccggcagcagcatgggcaccaccgagccgatgatgttgaacagcatgtgcagcagcaccgaggtgcgcagcagtccggtgcggtagtacgcgtaggacagcagcagaccgagcgcaaaggcgtagaaaaactgctccagattggcgtgatacaggccgaacagcagcgcggaaatgaaggcgcccggcttctgcccgtaccgcgcaagacggccggccagcagaccgcggaacaccagctcctcgcacagcggaccgatgatgcaggcaccgagaacgatggccgccatcggcatctgtgaaaagctctcgtccaccatgccgaccggatcgcgtccggtcagagcgtagaccatgtcgttgatattcgtgccgatgagcgaaccgagccacatcagcgcacagccgatgacaaaccagcggcccatgcgctttgcgcctgcccgctccctgcagaacggcatcggcggtgttttgcgccatatacagaacacgatcggcagcgatactgcataatgtccgacgagcagcagcaggtaatacagcgtttccggcatgcggaacggcaggatccagccgtccagccagtacaggccgaactgccagaggatcgaccacagcatgatcgccagcacggaaaatcccagcttcgagcagtagcggcgctcctgcgggatatcaatttgctccataaaagtttcctctccgggcaaaaacagaggcggagcctatgctccgcccccatatttgtctaattgacgaaaggcttactgagccttggcctcgtttaccagacgctcggtatccttggcgatcataagctcctcgttggtcggaataaccagaacgcgaacgcgtgcccagtcgatggagatatccatctgcttgccgcggtacttgttcttctccgggtcgatcttgatgccgaggtactcgaggtgctcgcaaacatcccagcgaaccgaacggtcgttctcgcctacgcctgcggtgaagatgatcgcatctacgccgcccatctcggcaacgtaggaaccgatgatcttcttaacggacaggttgaacatatccttagccagcgctgcacgcgcgttgccgtcagcaactgcagcatccagatcgcggaagtcggaggatacgccggagatacccagcataccggacttcttgttcaggatgttgatgacctcgtgtgcgtccatgtgctcgtgctcagccaggaactcgatgatagccgggtcgatgttgccggcacgggtgcccatcggcagaccgtccagcggagtaaagcccatggaggtatcgaagctcttgccgccattgattgcgcagatagaagaaccattgccgaggtggcaggtgatcaggcgcagctcctcgagcggacgaccgagcatctcagcagcctgctgggaaacgtacttgtggctggtgccgtggaagccgtaacgacggatcttgtacttctcgtagtactcgtacggaattgcgtacatgtagtgggactgcggcatggtctggtggaatgcagtatcgaatactgcaaccatcggaacgtccgggcccataacctcgcggcaagcctggatgccggtcaggttaggcggattgtgaagcggtgccagcggtacgcagtcctcgatagccttgaggaccttctcggtgatgataacgctgtccgagaagaactcgccgccgtgtacaacgcggtgacctactgcgtcgatctcgctcatagaggagatgacacccttttccggatcgagcagaatgttgataacagactggatcgcttccttgtgggtgggcattgcgatgtcaaacttgaacttctcatcggacttgttgccggtgtgggtcagcacaccgtcgatgccgatgcgctcgcacaggcccttcgccattacctcgcccgactcggtgtcgagcagctggtacttcagcgaagaactgccagcgttgattaccaatactttcatttgcgaaaactcccttatgccgtatttggcggcttgcataaagccgcggaagcctatataataatgctatatttttattctacacgattctttgcaaatgtacaacccctttttcgaggtttttaccttgcagaccgctgtcacctcactgaaaggagcaccgtcatgaccgtatgcggcatcaccgccgagtataatccgtttcacacgggccatctgcaccacattgccgaaacccggcgcagcctcggcgaaaacgccgtgatcgtatgcgtgatgagcggcaatttcgtccagcgcggcgattttgccgtgctggataagtatgcgcgtgccgaaatggccgtgcgctgcggcgctgacctcgtggttgaactgccgcttgcggcggcgctgtcctcggcggagggcttcgccaagggtgcggtgcagacgctgcacgcactcgggtgcggcacggtgtcgttcggcgcggagactgcggatacggatttgcttttacaggcggcagaactcctgaacagcctgccgatgaagggagaatccggctctccgcacctgtcctacgccgccagacggcaggaagaactcagcaaagtcaacaaacaggctgccgttcttttggataacccgaacaacacgctcgccgtggaatactgccgcttcctgctcccgctcgggatgcgcccgcttgcggtgctccggcagggcgcggcccacgatgcgcgtgcgccgcacagcggctttgcctcagcaagtctgctgagagcgcatttgcgagacggcgatttcgcgttctgtgcgccgttcctgccgccgccgtgccgcgcggtgtggaacgaggccgtcagccgcggtgaagcgccggtcgctctgccggaggacacactgctcgcgctgctgcggacggcactctatcagggcagactgcggaccggctcggcagacggctttgacgagcggctgtgcaaggcggtctatacggcacattcgttctcagatgctgtagaaaaggctcgaacgcggcggtttccggcggctcgtgtgcgccgtgcgctcctgcggtctgtgctcggtgtggagacggacgcacctgtctccccggcttatctgcgcgtactggcgctcggcgtgcgcggacgggcggcgatcaggcaggctgccctgcccgttatcgtcaaaccggcaacggaaaaacggctttccgacgctctacagcccgctttgcgccgcgacacgttcgcggatgatctgtttgcgcttgcacttcctgatcccgaacggagaatcggcggcggacatttccgcaaaacgccgttttgtctgcgctgaattgacaatcctctcattttgctttacaataaactttagcgttgtaaagtgaaacgaggggattttatgattggtcttggaaccattgtaaatgttggcacggtgcttataggcactacgatcggtatactgttaaaaaacggtctgccgaaacgctttgaaaaaacggtcatgcagggactgggactaagcacctgctttatcggtataggcggaacactcagcgaagtattgaccatacaggatggcgaaatcggcacccagcataccatgctgattatactctgtctggcactcggcgctgtcatcggtgaagcgctgaatatcgagcagcgactggaggatttcggtgcattctgtcaatcacactttgctgccaaaggggacagccgatttgttgaaggcttcgttaccgcatctcttctgttttgtgtcggtgcaatgtcaattgtcggtgcattaaacgatggtctgaatggtgacccaaccatgctgattgccaaggctattctggatggtgttgcctcgattctcttcgccgcatctctcggcaagggcgtatacctgtctattgtgccgattttcttctatcaaggcggcattacattgatggcacgattcatccgtccctggctgaccgatgtcttgatcggtcaaatgtcgtgtgtcggctccgtgctgatttttgccattagcttgaatctcatcttcaacagcaagctgcgcgtcggcaatctgctgcctgcgatcttcctgccggtgctgtttttctttctggcgcagtttttcccgactctcggcaccttataaaatcgacacagtttgactttcttttcgccctcccgtataatggatataacatttaacgaaacggagccgtaaactatgctcgcttacacttatcgaaaacagggtgagtttgccctgcagaacaagccggaacccgttctcacgcatgcaggagacgcggtggtgcgcgttaccatgtcgagcatctgcacgagcgatctgcacatcaagcacggctcggtgccgcgtgccgtacccggtattacggtcggccatgagatggtcggcgtggtcgagcaggtcggttcggcagtcaaaaccgtcaagcccggcgaccgtgtagccgtcaacgtggagacgttctgcggacactgctttttctgtcagcacggctttgtcaacaactgcaccgatcccaacggcggctgggcactcggctgccggattgacggcggtcaggcggagtacgtccgcgtgccgtatgccgatcagggtctgactgtcattcccgaccgggtttccgaccggcaggcgctgtttgccggcgatgtactcgccaccggctactgggcagtcaggatttccgagatccggcagggcgacaccgtgcttatcctcggtgccgggcccaccggcatctgcaccatgctgtgcgccatgctgcatcaccctcacaggatcatcatctgtgaccccgatccggcgcggctgcgctttgtgcgcgagcactatccggatgtgctgaccatcacgcccgagcacgcgcaggagtttgtgcagctcaacagcccgcacggcggcgcggatgtggtctgcgaagtggcaggctcggacgacagcttccgtctcgcgtgggagtgcgcccgaccgaatgcgatcgtctcgattgttgcactatacgacaagccgcagacgcttccgctgcccgatatgtacggcaagaacctcacgttcaagaccggcggcgtggatggctgcgacaccgcagaaatcctgcggctgatcgagtgcggtcagctggataccacaccgctcatcacgcatattttcccgctgaatgagatcgaagcggcgtacgatctgtttgagaagcgccgcgacggggtcatgaaggtggcaattacgccgccggaaaaataattgaggattgaaaatggagaatgggccacatggtttaccattctccattccgcaccaatacagcagaaaagccaccgtatcatccgatacggtggcttttatagcattatttttaatcaaccagcttatccagctcggcaacatgatgcgtgccggtcgcggtctggtgctccgcctgcttggcgtacagaccgaccacggtcgcggacttcttgatggactgcatcgtgcctgcaccggctacacagccgcccgggcatgccatgccttcgagcagataaccgttgtacttgccggccttggcggccatcagcagcttgcggcagtcgcgcagaccctcagcgtttgccaccttgatctcgcggtccgggtatttctcgttgatgacgttgacaacggccttggctacgccgccggacaccgcaaagttacggccgtcggacgaagcatcgttgatgccgtgcggatcctccttgagattttccacatcgatatgacgggcctcgaaaatgcctgccatctcctcgaacgtcagcacgaaatcgacctcgcttcgtacgtccgaacgcattgcttcgagcttctttgccgcgcacgggccgataaacgcaacctttgcacccggctgatggtgcttgaccaaacgggcggtcagggtcatcggcgtgagcgccatcgagatgcagttggcctgttccgggaacagcttctttgccatcatcgaccacgccggacagcaggaagtcgccatgaacggcagcttctccggtacttccgctacaaagtcctcggcctcctgtgccgcacacaggtccgcgccgatggcaacctcgataatatcggcaaagccgaggcgcttcatcgcggcacgcagcttgcccggtgtcatcttcgggccgaactggccgacaaacgccggtgcgacagcggcgtagacacgctcgcccgcctgaatggcgcggatcatctggaagatctgcgacttgtctgcgatcgcgccgaacgggcagtttacaaggcactggccgcaggaaacgcacttctcgtaatcaatatcggctctgccattgcagtcgctgtggatggcatccatgccgcaggctgccgcgcacgggcgctcctgacggatgatggcgtgatactgacagacatccatgcagcggccgcacttgatgcacttctcctgatcgataacagaacggccgttgaagcggtcgagcgatactgcgcccttgggacatacctcaacgcacggatgcgccatgcagccctgacagccgtccgtgaccatgacctcgttctccttgcaggcgtggcacgcgaacttgatcacgttgatcagcggcggcgtgtagtaggtctcctctcgggtcgcggcttcgatgttgtcggacagcggcgcatgctcggcggcgctgcggcacggcaggcccatcgccagacgcaggcgttcgccgacgatagcgcgctcgaggaaaatatcgttgcggatattgcccacttcgcccggcatgatatcgaacggcagtgcttcgatgcgacggtcggtcggccactcagtatggtacgccatacgggcaacctcggtgaaaatgcgatggcggatctcctgaatacgggtttctacacctctcatagccatagtttgttttatcctcctgaattcctttgcgacccattaagcgggtcttccctgtatactatcttattgagcgctcccggcagagcgcatatgctcttttaacaggataccataaacagggctttctgcaaagggtatttgtagattttttaacaattgctttgttaaaaatttacctatgttttttgggcattctgttaaaaaacaacgcgcagacggacaggtgtctttctatcccttgcaaaatcgaaggttttacgcttgacgaaaagcgagaggtacgctctgcggcgcgcgggaacggtgcccgccaacgcatttatgttataataaatttatcctctctgtcaggatacgcgatccgcaatcgtattataggtgaagcaacgttgctttccaaaggagctgaaaccaatgaaacaatttgacagggcagacgccgaacgtctggtgcagacgtactccgacctgatcctgcggctggcttacacctatttgaagtcaacccacgatgctgaggacatctgccagaatatctttctcaagctgctgaccggcggtcaaacctttgacagtccggcgcacgaaaaagcgtggatcatccgcgcgaccgccaacgcctgcaaggacagcctgcgcgccgcgcaccggcgcaatgtcggtctggaagccgctgccgcgacacccgcgcctgccgcaccggattccgatgtgctcgatgcggtgatggcgctgccgcgcaaataccgtgaagcagtctatctgcactactacgagggctattccgtgcgcgaaatcgcgtctctgctcggtcagagcgagtctgccgtttccgcacacctgagccgcgggcgcaaaagcctgcgcaccaccttgggaggggatctttatgaacagagagtataacgataacaaaatgtataattctgcactggacgagctgcgcttctccgaagaagcgaaaagccgcatggtcgatcgcctgatggccgccgccgagcagccggagcagccggttgccattcatcgtgtacgccgttttccgcgcatcgcggcggtcggcgtggctgccgctctggtgctgagcatcggtgcgggtgcaacaggcgtattcaagtccgcgagcgacgcatttgccggcgtattcggtctaacagcagacaccgaaatcatcgaccagatcggccgcccaatcggcgcgagcgatacggcgggcggcgtgaccgtcaccgcggatgcgattctgtttgatggctacaactaccttatctcctacacgctcgaaaaggaggacggttcggcgttcgactgcacgaaaaacccggataccggtctgctgaatgtgtactggaatcgtgcagacagcaatatcggcctgaatgcgcaaggcgcaatcggcagtagctatttctatgacgaaaatccgaatgataatgccattcagtatgttgaaaccatgtcgtacactgacgcagttacgaccggtggtacagcaaagattatgctcggcgacctgacagcagtaactgataacggcgctgaaaccaaaaccatcgccgacggtacctggcatctcaagttcaagctggaggccgataacagcgcggttgaactgcctgccggtcagtctattcaagtaggtggcaaaaccgcaacgatcaataaagtcctgctctcgcctatcggctataactttgtctacacggttgatggcaaagcaccgtttgagaatgccgaaagcggtcaggaacccgccagccaccgcgatacatgggacgcattttccgcaaaactgcttatcaataagaaggacggcactgtaatcgacgtgccaggcaacggcagcagcatggacccgcatgacggcaagaccgtctgcacccgccagggcacgttcgataccattctcccgcttgatgaagtggcgtccgtcaccatcggtgatactacgattccggtaaaataatcggcggagtgcttgcattatcgcaagatcggtgttatactatatttaaacgataacacattatccataggcgtggaaaaccccggagggtgcatcctccggggttttctattccattatacggcggcttaaaccggggttctgggagtcactttacctccactcatcgagccacttgcagatgtagtgtgcgactacacttgccaagattgagtagataaacgataacgtattgttatccacaggctgcacctccttcccgttgccgggactcggtaaagcaacaagtttattataccataccgccgtttattcgacaagattcgacaaaatgcaccgtaaagtaaaaagaccgatgaaccaaggttcatcggtctttctcttatcttcagatcgtcgtcagcagctttgcgaactccgcacgggtgaacgtaccctgcggcttgatcgtgccgtcgctgaagccctgcaccagccccttctgcatacacagcgcaaccgcattttggcggtccgccgagatagagcctgcgtccttgacagacgccagcgtctgtgcggtttcggcatcactcatggccgcagtgccgtccgcctgcagcagatttgcaaaaagctgcatcgcatcctcgcgggtcatggcagccgtcggccggaagttatcgctcaggccctcgagcagaccgtttgcatacaccgcgctgaccgcatccgagtaccactcgcctgcgcgaacgcctgcgggcagtgcgccgctgccggacagaccgcgctgacgcgcgatggtcgtgcagacttcggccgccgtgatcttatcgttcggacggaatttaccgttcgcgccggtcatcagctttcgctcggtcactgtattgatatactgcagtgcccagtaggtactgcctacatcgctgtagccggtcgcagcagccgaaactttgggcgaatacgacgtcatcaacgccttatagcacgcgctgttccggttcagtacatcggaaagctgctcaaacgtcagcagatattcctctgtataagctcggcgggaagcgctctcgtattcgttgtaaaaataggttacgcctttcgtgctgatgcgcggatagctgtacagataaatcgcatgatcgtccggcagcagcttcttgaccgtctcgatgtagtcaccggtcagcaggtcgttcagtgtgtactgcgtgccggtgtgcagatcaaacgccagacagttattccagaccgacgaaccggcgcctttgccgctctcgcagttggcccagacaacgagcaccgagccttccacggacgcaccgtagctgccttcgagcgcatcatactcggcggtaacggacggtcccttgaggaagaacgagcggatttcgctgttgatggtgttctgcacctttttgtcgctcaggccgctgatctccggaaaatcgacatcccatccatgctccgtgccgtcctgctgatagcccatgaacttttcgtaatgcacggtctttgcagtgatgccgccgccaaggtcgaacgacttcggctgctcgaacagcgttttgccgctgcgcagatcaatatacttgcgggtgtcgtcctgcgtgacgcagaccacgttttcggtcagaatggtcgggttctccgcctctttaacggatgctgcaaagccgccgtttttgcggaagaaaatcagtgtgccgtctgcagtgttgtgccacgacagaccgtagcgcagctcagagaagccgctgatgtagctcagcgtgcggtaagacaggctgccgcccgcatccaccgcggaaaccgaaccatcctcactgcgggccgcgtacaacccctcgcccatgtaggacagatagtaatacgtcggcgccgtcagcagcttgccggtggtatccatgatgccccagcggttgatctgacgaaccatggcttcgccatcgtgaaactccgaaatggtgttgtacagaaactcggtcagcagtttgccctccgaaagcgaatacagcgcctgattggtgccgttggtgacgaccaccgtgctctcgccgtaaatcgccatgtaggaaggcgttacgtcgttcggcagagtgtacagcaccgtgccctcggtgtcgattgcctgataatcgccgtcctgcgtctgcacaagcgttctgccgtttgagaacgcgccagccttacgatagctgcccgaaaatgcagtcgaaccatcctgcttgacataggaatacagaccggtatccgcatttctgcacagcagcagtccatcctcaaagaagccgaccgcgcccggatatgagccaatgcgcttgccgtcagtcgcataatacacgctgtggtcagtgtaacgatacgcaactatcgtatccgaaaaatccaccgaaaccggcgaatccgtgtatgcaatgacgatctttcccgtgcggtcgatcaccgccgtctgccactgctcgttttctacggcagcgagtccgcagtccgcgaaatcgcctgcctgcgcgtaggcaaacggaagaacggtcatgccgtcctcatccagatagcctgcgcgtgtcacgccgtcaatgtcggtgtactctgccggaaaaatggtgccggccgcagccgcactcaccaacatcacacacgcaaccgccagcgcggaaagtgtttttttgaacatatgcttcacctgtatattgtgtaaagttctctatccttgttattcttattcaatatacattataagcaatcacgcactctcatacaaggtcaggcggcaaagtgtaacaatggtgaaacaacccgccggaatgttacgattatgttacattcccagaatgcacatcagttgccgataatcggtgttgcgctcttggcgatggataccttttccacatacggcacatgcgcgtaaacgttggctgtggtggagatgtcggaatgccccagccagtcctgaatctgcttgagcgaaaagccctgctgcagcaaaatcgttgcaaccgaatgccgtaaatcatgaaaccggatacgcggcaggcacgcgcggcggcacacccgctcgaactcacgcgaaatgtaatccggccggagcggcgaaccgtcctcacggcagcagacgtaatcgctctggcagtaggctttgccgtactttttgcggttggcgttctgtctgcggcgcagatcggtcagataccgccggagcgagtcggacagcggcagcgtccgatagctggatttggtctttacgctgtccgcgtagatcacacgcccggaggacagcaccgccgtatgattgatgaccatgctccgtgcccgaaaatccacggcacaccagcgcagaccggcgcactcgctgcggcgcagaccataggttgccgccagcacgaacgccgcctctgccggcgactgcagcgccgctgccagaaaaatgttgatctgcgtccggtcgtacacctgtcctcgaaagcgcgtccgcttgggcagcatgacattatccgacggattcgtcgggataacctgcagtgctaccgcgtatttcaggcacttgtgcataatggaatggaacttaacgatcgaagtcggtgaaagcccctgatcgaattttaagttgacaaaatcctgaaaatccatcggccgtgccgtagcaagcgttgttcctcgtgcggtgaaaaacggcttgatgtgcttttcaaatgcgtagcggtagccgtccatcgtgttttcgcgcacctgcgttttcatctgggtcagccagcggtccatgaagtctgcaaacggcgttttcgcttcggtcgagtagcgcagccgcatcaggtcctccggccgcatgataaagtgaatgtagccgtcctcctcgtaaatgcgtatgttctccattgagaagcctcctgtaaaaatagtcatcctgcagcattcggcagcaccgcacactgagagctgcggtgctgtcttatcctgcatttccatattctacgaaaattcgaccaaattcgacaatattcaatttgcacagaaaagcaacaaaaaaccgctctgaatctgcattcagagcggttttatcggttttatggcaatcagatcgtgcggacagagatcataccttcgatcgcgcgcagctcgtcgaggttggcctcggtcggagcctctgcggtgtcgatgatggtgtacgcatagtcacccttggaacggttgcccatattctcgatgttgcagcgaacagcggaggtgatggacgcgatcatgttcgggatgttcttgtggatcatgcagatgcggtagccgccttcgtacggaaccttgaggttcgggaagttgaccgaattgcggatggtgcccttctcgaggtactcggtaatctcgtaaacggccatcttagcgcagttgtcctcgctctccggcgtggacgcacccagatgcggcagcgtgatggcattctcctgctcaagaatctcgtcggaagcaaagtcggaaacgtatgctgcaaccttgccgctttcgagtgccttcgccattgccttggtgtcaaccagctcgccgcgcgcaaggttgatgacgcgaacgccgtccttcatcttctcgatcgcctctgcgctgatggtgttcttcgtgtcagcgttcagcggaacatgaatggtgatgtagtcgcagtttgcgaaaatctcgtccagctcggtaacgtgcttgaccgagcggtcgagcttgagtgcgccgtcaaccgacaggtacgggtcatagccccagacctccatatccaggccaacagccgcgtttgcaaccttaacgccgatcgcacccagaccgatgatgcccagcttcttgccggcgatttccgggcctgcataggtggacttgcccttctctgcagcaggaccgatatccggcgtgcccttgaggcccttaacccagtttgcgccctgtaccaccttgcgggaagccagcagcagtgcacagataaccagctccttaacggcgttagcgtttgcacccggcgtgttgaagactacgatgccttcctcggagcagcggtcgatcggaatgttgttgacaccggcgcctgcacgcgcgatgcagcgcaggttcttcgggaactcgacatcatgcagcttggcagaacgcaccagaacggcatcgtaatcggtgaaatcctcggcgcaggtgtactttgccggatcgagatcgtccagacctaccttcgagatcttgttgtagagttttacgttatacatgggattatcctccaatagaaaatggagaattgaaaatggaaaatgtcgctatccttgcgcgataccgcaattccccattctccattatcaattctcaattattgttacttgttttcttcagcgaatttcttcatgaagtcgatgagcttctcaacgccctcgatcggcattgcgttatagatggaagcacgcatgccgcctaccgaacggtggcccttcaggttggacatgccggctgccatggactccttggcaaactttgcgtccagctcgtcgttgccggtgcggaaggttacgttcatgtggctgcgggaatcctttgcggctacagtcttgtagaagtcctgagaatcgaggtaatcgtacagcatggaggaacgcttttcagcacgctcctgcatagcctttacgccgcccatgtcttcaacccacttggcaaccagaccgagtacatagatgccgtacgtgggaggcgtgttgtacatggaatccttgtcagccatggtcttccagtccagcataaccggatacttctcgagcggatagttgccgagcagatcctcgcggacgatgacaacggtaacaccggccgggcccatgttcttctgtgcgccggcgtagatgacgccgtacttggaaacatcaaccggcttggacaggatgttggaggacatatccgctaccagctcaacgcctgccggggtctcgggatcgtactgatactcggtgccgtagatggtgttattggcgcagatgtagaagtagtcggcatccggacggatatccagctcatcctgcgtcggaacgtggtcgaagttggtctccttagaggagaatgcagcgtgcatgtcgccgaacttctgtgcctccttgtaggccttggaagcgaagctgccggtcagcgcgtagtcagccttgccggtcttcagcaggttcatcgggatcgctgcaaactgggtggtagcgccgccctgcaggaacagaaccttgtagttatccggaatggagagtacgcggcgcagcgtagcctcggtctccttgatgatgccgtcatatacctttgaacggtgactcatctccatgactgacataccggagccctgatagttcagcatgtcggctgcacagcgctcaagcaccggaaccggaagcatggaggggcctgcggaaaaattgtagatacgattgtctgccatagtgaatagcctgcctttcaaatataagcgtaaagacgttctcggtttacatatcacagtctgtcgcggtgatattacttttatgaatggaacgtattatttattataatacaaagctctgccgtttgctaccgaaaaatgtcccaaaaaattcgcaatgaatgaacgattgtctgcacattgtggacagttcatgaaaattagtaatgcgtaatcaaaaatcagtaattttttgtgataggtaaatgtacggctgcgaatatggactgcacccatgttctctcttatgactgtttatccggactactgcagggcggggtgaccccaccccgccctgcactaacacttttagaaaatattataggcaataccgcataattgaacaagagtgatttgcgagtaaattttgcgtactgacgaggcacagttttgcggtaatacttgatgtattaccgtgaaactgcaacaaagtcaggacacaaaatttccgcaaagcaccgccgctttaattgtgcggtgttgcctatactgcgttattctcaatttgccaacctactccccttctgctatactgatagtcagttataatagtaaggagtcaactgtattatgcaccaccgccgaccggctgcgccgcacagccaccgtcccaatcacagacagatcaaccgcctgatgccgttcacgacggcgccgctgttccatgctctgcagctgctcgagaccggcgactccgcgcggtttcacatgcccgggcacaagggtgagccggttttcaacacatacgcggatatttttgccatcgactttaccgaaacctacggcaccggcaacctgtacaccggcgaaggccctatccgcgatgcggaggttgccgccgcgcggtatttcggctcgaaggactgcttttttctgaccggcggctcgacacagggcattctcgccatgctcggcacagcggtcggacgcggcggcgctgtcctgctcgaccgtgaggtacacaagtccgtctgctacggctgcgcgctgctcggcattacgccgtatttcttttctgcaccgctgattgagccattcgcggtttccggtgcgcttccggtcaaggatgcggaagcacagctgatcgcgcatccggagatcaaggcaatccttctgacctctccgacctattacggtatccggcgggcgattcccgagtttgccgatctgtgccgcgcgcacggcaagctgctgctcgtagacggtgcacacggtgcacactttcctgccgtcggcctgccgacgccggtcgcggaaggtgcggatatggccgtgctctccatgcacaaaacgctgccgtgcatgggacagggcgccgttctgctctctgcggcaggcgtggaccgccgcgcactgcgcgaaaacaccatgctgttcggcacgtccagtccgtcctatcccattatggcatccattgaccttgcgcgtgcctacaccgaggggcccggtcacgcggagtaccgccgctcggcggaaacctgtgccgaactacgtgcctatgtgcagcaccgaaccatgttcaccgcactgaccgaggatcattttcctgcgcttgacccatgccgtctgacggtgtgcaccgccggaaccgacatcaccggtcaccagctggccgatacgctgtggagcgaatgcggcgtggcgtgcgagatggcggacgaccgcaatgttgtgttcatcctcaccggctccgacccgaacggtgcgatcagccgtctgaaacgcggtctgcggcgcatttccagacggcgcgagctgattcccctgccgtccctgtccgcaccgtttccgcccgccgagcgcgtgatgagcgtgcgcgacgcatggttctcacagaccggcagagtccagcctgccgctgccgagggtctggtctgcgcccgtccggtcacgccgtatccgcccggtgtgccgctgctctggcccggcgagaaaattacaggagcgcacattgcacttatccgtgaaagatggtacaatacaatagatgaaataaccgttgttgtccatcaataacgcatctcatccaagcaaacgatatgtttccgcgcagcaatgcgtatagggggttactattatgaaaatggtactggctatcatcaattacgatgattcgcaggatgttatctccagcctgatgaaagcaggcttctccatcaccaagctggcgaccaccggcggtttcctcaaagcaggcaacgtcacgatcctgatcggtctggacgaaagcaagctggatgagtgctttgacatcatccgcgagcactcctcctcccgcaagcagatcatgccggcaaccgctgagctcggcatgggctttttcccgtccacgccggtgcaggtcgaagtcggcggcgcaaccgtatttgtactcaacgtcgagcgttttgaaaagctgtgatttcatttgacgcacttgcgggcaacaatgcgctcaaaaacagcctgaagcatgcgctgaacgagcggtttccgcagaccgtgctgctgtccggtgacgatccggcggcgctcaaaacccttgcgactgtactcgcggccggtattttatgcgaaggcacgggcagtcatccgtgcggaaactgtctgccgtgccgcaaggtggagcagggtgtgcacccggatctgttgatcgtggacgaaggagaggccgaactcaaggtcgatctggcgcgtcagctcaaggcggaaaacgccattatcccaaacgacggcgaacgccgtgtgacagtcattcaccatgcgcagaatctcaatcccatggcgcagaatgcgctgctcaaggagctggaggagccgcctgcgtatgcgttcttcattctgaccgccgagcagccggattcgctgctgcagaccgtgcgctcgcgctgcactaaatttgcgctcgagccgtcgcaggcggcggtgtcggacgaggaagcggcaagcctgcttgctccctatctctctgcggttgccgaacggcgcgaggaccgcatgatgctcagtgcaatgggtctggaaaagacgccgcgccgcgcactctcaggcgtgctcggcattctgcaggccgctgtccgggacgcgattttcgtctcgaaggctctgccgcaaaagccgctgcagcctgcactccgcaagcagacgcaggcactcgccggcgccgtcagtatggaacgtctgttggcggtctacgattttattgatgtgctgatcgaccgtgtgtcgcgcaacgcggcatccgcggctgttacctgtgcattaacgagcgatatttaccgcatctgttacgcttcctaagcgtttccatcatacaggaggaaaactttttgacaacaataatcggagttcgtttcaaatcgaacggaaaaatgtattatttcgacccgcagggtctggaaatcgcacccggtacgggtgtgattgtcgagacggcccgcggcgtggaatacggcgactgcgtgcagggcaacaccgatgtgcccgatcagcaggtcgtgcagccgctcaagcgcgtggtccgtgtggcaaccgagaccgatatgaaaacgctcgagcgcaacaaaaagcgtgccgacgaggcgtttattatctgcaagcagaagatcgaggaccgcggtctggaaatgaaccttgtcaccgcggaatgcacctttgatatgaacaagctgctgttttacttcaccgcagacggtcgtgtggacttccgcgagctggttaaggaccttgcgagcgtgttccgtacccgcattgagctgcgccagatcggcgtgcgcgatgaggcgaagatgatcggcggtctgggctgctgcggccgcgagctgtgctgcagctcgtatctcgatgatttccatccggtctccatcaatatggcaaaggatcagaacctgtcgctcaatccggcgaagatttccggtgtgtgcggccgtctgatgtgctgtctcaagtatgagcatgaggcctacgccgaactgcagaaggtcacgccgcgtcagggcagcgtggtcgatacgccggaaggccgcggcaaggtgatttccacccagatgctgcgcggcacctgcaaggtgcagctggacgacagtccggagcactcgctgaccgagttccagtgcacgcagtgctgcatggtaaagggtgcatgccgcaaccgtcagaatgccgccgctatggccgaggaacgccgcaagcgcgaggatcaggaggatgctgccgctcccgcacccaaaaaggatgcaccgaaaaagagcgagactccgcatcagaagccgcagcagccgcgtccgccgcgcaagcctgccccgcagcagactgcaggagacgaactgcccgaagatgctcagaatgagctgtctccggacggtgaaggtgcgccgcgccgtcgccgccgcagaggcggaagacgccgccgcaagccgaatggcgaaaacggtgctccggaacagaattccggcgaagaatgagaaaaagagcgaaaccgtatggtttcgctctttttttgcgcaaatacagccgctcccctctctgcaagcgcagtgaagcaaattgactgcaatgaatcatgctttctaccattctcctgcttattttgccgtggcagcgtacttatcaaccagcgtctgcgccattttcatcgctgtctcgcccttattcaggcgcagcgacagatacggtgtcgaaccggcattgagcagaaggcggcccttgaattcactatcgccgcagagcgcggacaggcgcgcgaaatcggtctcggagaaggtgagcagcagtcgtccgtcctgctgcttgatctccgcaatcccctgctcgctggccttggcacgcagcagcgcgatatccagcagcgcgatggcctccgcaggcggctcaccgaagcggtcgatcagctcatcgagcatatcactgcgctgctcgtccgtgcggatgagcgcgatacggcggtacagatcgacacgctgtcccgcatccgcaacataatcagcgggaagattggcagaaatcagcagctcggccgcacaatcgacacgcggcttgggtgtttcgcccttctcctcctgcacagcctcttcgagcagcttgaggtacagatcatagccgacgctcatcatgtggccggactgctcgggaccaagcacattgccggcaccgcgaatttccagatcacgcatggcaatcttgaagcccgagccgaacgctgcaaactcacgaatcgcaccaaggcgcttctgcgcgatctcactgagcgccttgccatgccgatagcacaggtacgcatacgcatggcgcgacgaacgaccgacacggccgcgaatctggtgcagctgcgccagacccatattgtctgcgttctcgatgatgagcgtattcgcgttcggaatgtcaatgccggtttcaataatcgtggtgcagaccagaatatcaatctcgccgtccgccatctcgttcataacctttgcgatctctttctgccccattttgccgtgaacgatgccgattcgcgcatccggaagccgctgctgccacatgttcgcacatcgctcgatggactccacgcggttgtgcagatagtatacctgtccgccgcgtcccagctcacgccggatggcatcaagcagcacaccgtcgttctgctcaagcacaaacgtctgcaccggatgacggttctgcggcggctcctcgatggaggacatatcacggataccggacagcgccatgttaagcgtgcgcgggatcggcgttgccgacagcgtgagcacatccacgtttttgctcatttccttgagcgtttccttgtgcccgacgccgaaccgctgttcctcgtccacgacgagcagaccgagatccttgaacttgatcttcttgttgaacagcttgtgcgtgccgataaccagatcgaccgagcccgcctccagctttttgagcagcgcagtctgctccgaaccggtcttatagcgcgttaacagctcgatcgtgatcgggtgaccctgaaaacgctgcatcgcggtcagataatgctgccgcgcaagcacggtcgtcggtacgaggatagccgcctgcttgcccgcgagaatgcacttcatcacggcacgcagcgcgacctcggtcttgccgaagccaacgtcgccgcacagcaggcgatccatcggccggtcggactgcatatcgtccttgatctcggcaatgcagcggagctgatcgtcggtctcctcgtagggaaaatcctcctcaaactcgcgctgccacgcgtcgtccggcgggaaggcgtagcccttgaccttggcgcgctcggcatacagcttgatgagaccctcggcaagctcctttgcagccgctttagcgcgtgctttcgccttgctccagtccgcgccgccgagcttgttcagccgcacgcgctcgttgtcgccgccgccgatgtatttggagatgaggtcgagcgacgtcgcgggaacatacagaaaatccgtacccgcaaacgcgattttgatgaaatcgcgctcggaaccgtccaccgtcatgcgctccatgccgataaaccgaccgataccgtggtgctcatgcacgacaagatcacccggtgtcaggtcggtgtacgacttcaccttatcacggttggacttcttgacctgcgttttcttccgccgggcaagaacctgtccctcggtcatgacaacaagaccgagatcgggatactcaaagccggcagacagcgtgccctccatgatgttgacacagccgcccttgggcagcagatcgctgatttttacgttgagaccggtgtcggtcagcgcgtccagcatgttctggcagcgcagcgcactgccgcacacgaccgccaccgcgcgtccctgctcggtatagctgcggatatcggcagacgccatgtcgaagttgccgccgtaggcgttcatctggttggcgataaagttttccagatgctgcggtgtcagttcggctacgttgttgagaaagctgtccagacgcagaatctggcgcttcacgctgcatacgccgacaaaatccagcgcatactccccgagggcgggcggcatttcgccgcgctcgagcagagcagttacgtcgtcggctacacgcgcgtggaaatcgcgcaccgcgtcgcgcagacggggcgtgtcctcgatgatgacgatggcattttcgggcagatagtcgaacgcggtcgccatttcgggataaatgagcggcatatacttgtccgctgcgggcagcgaaccggtctcgcgcagacgttctgcgtcccgttcaaggttagtctgcaaatccgcgtgctgcttcttccggcgggtcgaggtgagtgccagaacagcctttgctagtcctgccgcaccgcccttcgccagtgcaggaatggattccatgcacggcagacagcgcaggcactcgcactgctccaaccggcgctgactgccgacgtcgaacgtggagattgagtcaatctcatcgtcccagaattccacgcggtacgggtgctctgcctgcggcggaaacacatcgaggatgccgccgcgaatggaaaactgaccggtgccttcgacctgtacgcagcgctcgtagcctgcgcgcgtgagcgactgtgccagctcatccagcggcgcggtctcgcccgccgcaagcgtgacgatggccgttttgagcgcctccggcggcatggtgcgctgggctgccgcctgcacggacgcgaccgcgaaatgcgcatcacgcagctcgtccagtgctgccagacggcgctgctcgtagccgcgcgacacaccgactacatccgccatcaccagctcacgagagggcagctgtacaatatcacgctcggaaaaaccgcgcagatcagcggcaaatcgattcgcagtgttgtcgtcgtcggtcaaaaacagtaccggacggcctgtatccagtcctaacgccgccgccagatgcgccttgtggatggctgataagccaaccgccagcaccggagttttgccctcatcaacggcttgttttaactgtttgtattcttttagaaaagttatactttttgtaatttcgttcaagaggttcacctccctttcataatggaaaatggaggagtccgcctgtaaaggcggttatcgaataatcgcgcaaagcgcgataccagcgcagcgcgactgaagtctgcgcaaggatagcgctaattctccattattcattcttaattattgagacaccaaaagggcagatttctcaatctgccctaatgttatgcgtattttttgcggaatatgcgtgttagtctgccttgtggcaggtctcacagtctgcatcgcagccgagaatctccgccgggtccttgcccagacgcttgtaatagtcggaaattgcagagcgcagcgcttcctctgccagcacggagcagtgcatctttaccggcggcagaccgtccagagcctcagcaacggccttgttggtcagcttgagcgcttcctccaagctcttgccctttaccatctcggtagccatcgagctggttgcgattgccgcgccgcagccgaaggtcttgaacttaacgtcctcgatgatgccgtcgtccgacaccttgaggtaaatcttcataatatcgccgcactttgcgttgccgacctcgccgacaccgtttgcgtcctcaatctcgccaacattgcgcggatgcgtaaagtggtcgagtaccttttcactgtactgcataaaatctatctcctttttgtccaatcaaatgaatatattgcaggaaaatcaatcgtagggcgcgacgaccccggcgcgccaagtcgtcgcgccctacgggatacgtttccgcttatcttaatgtgcgtgcagctcggttgcagcggtcaggttaggatgaccgttctcccaaaccgggctcatcgagcgcagggtcttaacaacatcggtgaccgtctcgatgatataatcaacgtcctcctcggtgttctgctcgccaagggtcagacgcagagagccgtgcgcgatctcgtgcggcagaccgatcgccatcagaacgtgagacggatcgagcgaaccggtggaacatgccgaaccggtggagccgcatacgcctgcgttatccagtcgcaggatcaggccctcgccctcaatcgcctcaaagacgaacgaagcggtgcccggcagacggtttaccggatcgccggtatagtgagagtacggaatgttctccatgatgcccttaacgagcttgtccgtcagcttcttgacgtagcccatcttctcatccagaccttcaacggcctccttcatcgctgctgccagaccgatgcagcctgcggtgttctcggtgccggaaaccagaccgcgctcctgaccgccgccgtataccagcggctcaagggtgatgcccttcttcacatacagcacgccggtgccgcgcggaccgcggaacttatgaccggacagggacagcatgtcgatgcccatctcctgcacgtcaatgtgcatatggccgacagcctgaaccgcgtcggtgtggaactttgcgccaaccgaatgcgccagctcggcaatctgcttgatcggctgaatcgtgccgatctcgttgtttgccgccataacggaaaccagtgcggtgtcctcagacagctctgctttcagctgctcaagatctacacggccttccttatccacattcagataggtaacgcggtagccttccttctcaagcgcctcgcaggtgtaaagcactgcatgatgctcgatcttggaggtgatgatgtgcttgcggcccttggaagacggaccgtgcataaagccgcggatcgcaaggttgtccgcctgcgagccgccgccggtgaatacaatctcacccggtgcatagtcgttcttctcgttgaccggctctgccgcgttcaggcacttgccgacaacggtacgcgcatcgttgagcgcttcctttgccgcacggccgatgcggtacagagaggacgggttgccgtagttctcggtcagccacggcttcatagcgttgaacgcagtttcggacatcggggtcgtcgccgcgttatccgcatatacaaatctcttttccatagtatatctgcctttctttgtccaaaaaggttgtcttaaacacaagctgaacagacggttttcgacgcgcgaaaacccgagtaaaatgataggttcagcgggtactattaatatacacccgaaacgggtattttagcaagtgaaaaactgacgaaacagcacgcatatcctgctgcattttgcattagtttgtgcattttgtgtagttttataaggaggttagctttgttttaccggtgcgtgtgcgtatcgaggcgctttttcagccgttcgagcacctcggtataacgctcggagcgggcggtcgggttgccgcgcagcaggctcttgcgggtgcggccgagtgcggctgcccgctcgtcaaagcggcgctgcagctcgtcgagcttggcctgcagctgctcgcgtgcggcttcggtctgcgccctgcgctcgtcggagcgcatctcatgcacggcggcaagctgctccttcgcatcgtccattttctcggagagctgcgctttcgcgtcggcaagctgctccctggcatcgtccacacgctcggcaagctgtgccttcgcctcgcccaccttctcagtgaattcgccgtgcgcttcctctacacggtaggacaggtttgtcagaccgacaagcgcagtctcggacagctgctgtcgcagctcggctccctgctcgcgcaaacggtcgagttcctcgagcaccttggcgagatcgagtgcgctgcgtacggatacgatcacatcgctgataaatgccgccgaaaacagaacgtcgatcacgatcaacccgataaacggcagaccgagcaccagcttttcaatcggcgggtgaatgacgctcgtcaggatcaggccgagaaagccccagcacagtgacgagcgcaggcagatatagccctgaaactggaatctctgcttggagtaatcccagtattttaccttgaatatcttctccatcaccacaccgacaatgtattcaaacacagtcgccgcgatcatgctcgccagatacagccacaccggatgctgctttaacggcagagaaacatgcagcaggatcacggcgccgaagccgtaaatcggcagcatggggccgcgcaggaagccgcggttgaccagtctgcgctgtcctaccgagaccacggtggactcaaagcaccagccgagcatacagtacaggtagaaaaccagcagccactgggcagcggaataactgtaatacacgctctcactcctcatgatttggatttcgtatctatttattctatcgaattttttgactttttgcaaggggaacgatataatagaatcataccattttaataggaagggtaggaacgcctaatgctgaattttaatctgcacaccacgactgagattgtatttggtaaagatattgaggaacagatcggcccgcgtctgaaaaaactcggcgcacatcgcatcctcgtacacttcggcggctcgagcgcccgtacctccggtctgctggaccgtgtggaaaaaagcctgtttgcggcgggtcttgcctttgttgaactgggcggtgtatcaccgaacccgaaggtatcgcttgtccgcaagggcattgcactggcagagcgagagggcatcgactttgtgctggcagtcggcggcggctcggtaatcgactcggcgaaggccatcgccatgggcgttgccacaaaaaccgatccgtggcagtttgcatctaccggcacaaagccggataccaccctgccggtcggcactgtactgacgctggcagcctccggctcggaaagcagcaactcctgcgtactcaccaatgaggagaccaaggagaagcgcggtatcacgagcgagaccaaccgtccgcgcatcagcttccttgatccggagaacacctataccgtgtccaaattccagaccggctgcggcattgtggacatcatgatgcacacgctcgagcgttacctcacgccggaaggcggcgaaagcgacattaccgaccgcattgccgagggtctgctcattgccgtgcgcgatgccggccgccgcgctatcgccaatccgcgcgattatgaggcgcgtgcgtccctgatgtgggcgggcagcgtttcacataacgattacaccggctgcggccgcaagcgtctgttcccggtgcataagctcgagcatgagctgtccgcgttccgcgatgagattgcacacggtgccggtctgtccgtgctgttcccggcctgggcgctgtacgaaatgaagaacgattttccgcgctttgctcagctggcgaaccgcgtatttggcgtggagatggatttccatcatcccgagcgcaccgcgcgcgaaggcatcctgaccatgaagcgcttctttgaggagatcggcatgccgacgcatctggcgcagctgggcatcaagccggagaattacgcacagctggcagcgaataccgtccgcacggtcaagggtccggtcaagagctattccgcactcgacgaacaggctatcatcgagatttataagctggcggagtaaaaccgcctgtgccaaagacggtgcaataagcgtaacaactgcgaagggaaggctgtgcagcagccgctccctgcagcccatcaccaaaaccataatgaccgctcggtaccagccgaacggtcatttattttatccatctccgcaattaccgtccggtcggacgtttttttgcttcggggttgctctgaactgccgaaggtggtaggataaaagcagcaaagctatcgagaacaaatgaaagcagggattttatgcaaattgtagataccggcgtactgaccccgtccttcatggacttctcactgccgtccgaatttgcgaaaagtgcgctgtattactgcccgcagttcggtcagttcatctgcaacagcgattaccggatcgaacgaaacggcattgaccaatacctgctgatctacatcaacagtggttcgctctgcatccgcacagacggtatgaccgccgaggcgcatgagggcgaaatagcgctgttcgactgccgcaagccgcactgctactggtgtccggacaaggttgacttctactggtttcacttcaacggtgcgggcagcaagcagtacaccgaatatctgaccgagcgattcggccttgtgcacgaaaagcagccgatgctgtcgctcaaggatcagttccgcacggtcgtgcactcggcgcagtacggcatgagcacgcagtttgcctccatgaacgagcaccagatttccattgcggtacacagcattctgggtggtctggcgtcgcagaccgtgcgaaccaccgtcaccagtgagctgcttgcaccggcactggcgtacattcacggtcattttgccgatgatatttcgctggacgaccttgccgggatgtgcggcatcagcaaatcgcactttatccgcagcttcaagcgatacgtcggctgtacgccgcatgagtatctgctgcagtaccgtctgcgtcagtccaagcgtctgctgctgtccagcgacctgaccgttgaacagattgccgaggactgcggcttcaacagtgcatcgcactttgcgcgggcattccggcaggagacggatatttcgccaacggcgttccgggctatttcgttctgattttaccatatcagacgttatctgtgtgctaaagaatacggaatgggtgctaacccttagctggggttccaaaaggatagacaccaaagtttgcccgtaggccactaaaccttgttcctgcgccgtgcgcggattaaacgagtactatcctcttgggactccagtttcctttatttgtttgtctggcgaaaatcggagagcggcgaccgcttcgaaatttgggaacggcagtcgggtgaccgttgcgagtctttctccgccttttcgcagttcacagataacttaccgctacacaggcggtttcatctcagcaggcgcgacatacccgtgtcgcgcaactcgttagtctggatatgacagacagcacctgcgaatttatctatttagaaccgtttagccgcgcaggtgctttctattaccacgtgccgacaaattgtgcagcactgctatgccgcaccttgcgttgatgaaaccgtatgtgtagcagcaaggtatccgacccttcgaataggttgagaaagacacggtagtaaaaatcctctgccgttcccctatttcggagcggtcgccagtctctggtatgcgccagactaagaaataaagtgaaacgggagttaagagggtagaaaccgcaggtgtctaccctcttgcccccgccgccgagcgcggcaaatcctctcgctgaggttcagcgaaaaacaccccgcccgttcgggcgaaccgcctgcgcggttcgtgtgccccagaaagccggtgccgaatatctgaacgcaaaaaagacagaccgcaacagtgatctgtcttttatttcggtttgctttatcagccgcccagacccagaggagagaacagcacataaatgcctgccagcaggatgaacgtaactgcgataaccggcttgcggtacttccacggggtcatatcaacaacctcgaggtcaggcagtacatacgcttccttgcgcggtgcagccttggtcagaatcgccatcaggatcaggtcaattacgaatgcgcctacttcaaagtacaggaagtggaacggcagaaggttcatcatcaggccatagcatacgatatggacaatgatggcaaccttcggtgcaaagctcggcatgcgcggagccagaatacccataacaacgatggccagaaccggaacgccgtagtagccccacatctgattgaggaaggtgctgatgccggccggcagatacagcaggaacggtgcgataataatggatgccagacacagcacgatgccgaaacgctttgcaatggtgatcagctgtgcatccgtgcgcttcctcttggagataaccggaaggatgtccagggtgaacagcgtcatggagctgttcagtaccgagttaaaggaggacaggatcgcaccgaacatgactgctgcaaagaaacccagtaccggagtcggcaggatgtccttgatcagagacgggtacgccatatcgaagtcggtcagtacgccgccgtcacggatgaactggatcacgccgggcgctaccagaaagatcgggcagaatacgcaggtaagaccggtcagcagcgagcctttctgcgcttccttcaggttcttcgcgccgagtacgcgctgcatgatggactggttggtgcaccagtaagagatgtggttgataccacagccaagtacgatcatcggccacggaatgtacggcggctgtgcgttggcaggctggatcgcattcaggtgctccggagaggaggtagcgaaaagacggatgccttctgcgatgctgccgtcgcccagcgcgataaatgccagaaccgggatcaggatgaccgcgccgatgataaagatgatgccgttcagagagtctgatacggctacggccttcaggccgccgaagattgcatagataccgccgattatgccgagtgcgacgcacattacggtggttgccatgaaacggttgccgcccatcagtgcggtaataccgaagatacgctccatcgctaccgagcctgcgtacagcaccagcggcagcatggttacaatataagcgacaaggaaaatgaacgatacaatgacgcgggttgcgcggtcaaagcggctttccagaaattccgggatagtggaaatgcctagcttgaaatacttcgggatgaagaacagtgccatcagcgtcaatgcgattgggcacatggtctcccagcccattgcagtcatgccggctgcataaccctgaccgttgcggcctaccagctgctccgcggacaggttggtcatcatcagagaaccaaagataaccagaccgctcaggcttcggcctccaaggaagtaaccgtctttgctggtctcgtccgttcccttggttttaagccagcttacgaatgccactgctacagtgacaagcacaaatgaacccagtgtaaataccattttcttgaaacccctcttgtttgctgtgtaaatacgctgccacgggtatttgcagcagcgtgtccctctttttctctgcagcctacaggataatctgtacggaattgctaattttgtatatctcatccaacttcattccatagcaatgccccctaatcctgcttgggcaggagcagggggcaccaccatatagagaaatagaatgagagaaaggatctttgaaatttgcgttatatccatatcggattggcagaacgttggagcgttttcctgccgatccgtagagaggatcttacgcgtgaacattatcgcacaatctgcgtttgtgcgaaatgcagttttcttagtggagctgcgtcttcagggtatccagacgctcctgcgcgttgtccggggtaactacgtcagaaccggagtcaacgaactcgtcaacggtctcgccgtccagaacctgaaccatggtctcaacagccttgtagcccatctcgtaagccatctgggcaacagacatcgtcatctgaccgtccaggattgcttcacaagcagcgcggtcaccattgaagccgaggaagatggtgttcttatatgcgtcatggccctgcgctgcacgggctgctgccatagccatatcgtcgttgtttgcgcaaatgattgcgatgccttccggatgtgtctgcatgatagcttccatagcggtggtagcgcggtcagcagttgcatctgcgtactgtacttcatcgctcaggaaggtgccgcctgcttcttcaacgccagccttgtagccgttcatacgagcggtgttggtctggtcgccctgtacgcctgcgatctcaatgcacttgatgtcggtccatccggcagccttggcagcctctacagcagcctcgccgcccttcttggcagcagcttcgttaccggtacctacgaaggacttaacctccggtgccgtgaagttggtgtcgatcgcaacgatcggcagcttggtgccgctgaccagctgcgctgccgtatccgactgcagcggagaaataacaatgccgtcatacgtgccggagctgaggtcggtctcgatcatgttctgcatttcatcgaatgcggtctcagagcttggacccttaacctctaccgtaaccttgtccgaatgctcggaagcataatcctcagcgcccgactttacatactgccagtactcggcagccagagtcttcaggataacgctgaccttgtagctgccgccggaagcggatgcgccaccgtcattactgctgtcatcggtcgaggcagaattgccgccgccgcatgcggtcatcgacaatgccatcgctcctgccagcaacatcgctaacactctcttcttgttcataatttcttctcctctcttttttccgggccctgctctctcagtgcccttttacgcttgtgtatttcacacttgcgtgtactctttatcagcagtccctcttgattttctgttggaggaaattcaagagggaccggataacaaaataatgaaaacgggaatggtgtagatgcgattgtaaaatggggattgctatgaaattatggttaaattagaaaccagccttgcgcaggttctcacggccgatggaagccttctccagcggtacgtcgaaggacttgaccgggaatagatcctgctctacgacgcaccagccgtcgtagccgcactcgtcgagtgccttatgcatagcagtgaagtcgatgctgcccttgcccggctcaaccatgatatcctcggttacagccttggcaaaagaccacttgttctcgtccatcttggccttgactgccagatcgcagtccttgaagtggatgtacgggatgcgcttagcccacttcttgtagaaggagatcggctcgccgccgccgtatacatggtggccggtgtcgaagcacagatcaacgttggtatcattcaggaagcgctcgatctgctcctcggtctgaacgtggctgtcaacgtgcgggtggaacaggccaacaaagccgttcgcagcgcagcggtcagcgcacttctgtacattcttgcagtaggtagcccactcctcgtcggtcagctccggattcatctccagctcgccggtagcgaggttggtgtacatcggaggcagcagaacgatatacttagcggacgggaaagccttcagcagcttggaaatatcgtcgatatccttcagcataccctcaacagcagcgtcgtcgaggaagttgccgccctcggtagcgcctaccagagtcaggccgcgcgcatccatagcgttcttgagaaccttgggatcgtcgttcggcatgtagccccagggaccgatctcgcagccctcgtagccggcaaccttcatttcgtccaggcagcgccaccactggggctgttttgcgttgttcggatcgcttgccgggaaccatacaccccaggagtccggtgcaataccaatcttgatagccataattatatcctccctgtcaaattattcaggaaactgtcagccttttcggtctcggcgggatcgctcccgccggagaccgtttcggcattatgttttaattgatgtaagcggacaacttacttaacgtcaacccactcgtgagtcttggaggactcgataacagcagctacggtgcggtcgatcttgtagccgaactcgaagtcggttacatagtcagcgccattggtgatagcgtcgaacagagcgtgaacctcgaggatcttcatgtcgttgtaagcgatggagataccgcctgccggctggaatgcggagtagcccttcatcagcgggttgagcagtacggtgcggaagccgcggtcgcgctcgttgtcagactggaagtaaacctgaacttcgcccatgcgctccagatcgtaacgaacagaacccttggtgccctgaatctcgtaggtcaggtagttcttgcggccggtagcaacacgcgagcaagcgatctgaccgatagcgccgttagcgtactcagccatgaaggtcatgatgtcctcgttctcaacgtcaatcatctcggtggagcctgcggacttcggacgcttcgggaatacggtggtagcaactgcgtttaccttggtgatgtcgcccatgatgaactgagagatggacagcaggtgggaaccgaggtcgcccagagcaccgcagccagccagcttgttgatgtggcgccaggtgatcgggagggactcgtcgagcagctggtcctgatcgtaagtgccggtgaagcgcatgatcttgccgagagcgccggactgaacgagctcacgaacgtaagcatttgccgggttctgggtgttgttaaagccaacgtagttaactacgcccttctcggcagccagctcagccagctctctggactcctcagcggagatggacagcggcttctcgcagtatacgttcttgccgttctccagagcagccttagcaactacatagtggaaagcgttcggggtagcgatatcaaccaggtctacgttcgggtcggtaactacatcgtgccagtcggtggagatgcgcttgaagccgatcttcttctgtgcggactttgcagcctcttcgttagcgtcagctacgatctcgaaggatgcggtgccgtagtcaggaccaaacagcatctcagcgtcagccagtgcagaggaatgagccttgcccatccagccggaacctaccagaccaatacggatttctttcatgataatttcctccttgacatttaaatcttagacatactcttttcacgatttaccggaagtttttttgttttgttttaactttcggtgttttcgtttgtttgactatattatagctgcggaagagttatatcgcaatgcactgtataactctgttctatacaaaaattactcttttcattctggcattgtatggattgcacacataaaagcacagacgtttgagcaccttgctgaatatcaatttcattccgaaaagcatcaaaaaaccggcggaaattcttacccgattttatcgtgcgaatatgcccgtgcacacattttgcgaaaataagaaagggaacttttcatgagaaaacccgcaggattttccgcatgcgaagcgaaccgaacttgcctgcccggcaggggcacaagagggtagaaaccgcaggtgtctaccctcttgccccccgccgcggagcgcggcaactctccccccgctgaggttcagcgaaaaacgcccgcccgttaggggcgtattgctgacgcaactcgtgcaccccggtcaaccggtgctgagtaacacaaaaagaggctcactctcgtgaacctcttccgcaaatcgtatcaaattgtacttattttgctttcactgcgccgtccttgatcaaatcccagttcttcttgagataatcatagccggagtaaatggtaacaagcgttaccacccagccgacgatggtcagcagcagcggcataccatccgcatgagggatgaacataacagcggtaacaccatcgccgtccgcgaaggcgataccgtttgccagcgcacccacgatgatataatacagataaatgatgatgataccgccaatctgcacacaggtcttgaccttgcccgtccacgttgcagccataacaacgcccttattggctgcaaccacgcgcagagacgtgatgatcagctcacgcgcgaggataacgcagaccatccagcctgccatcgccttctgctctacgaacaggataagcgcagacgctaccagcagcttatcggccagcggatcaacgaacttgccgaaatccgtcacctgattgtactttcgtgccacatagccgtccagaaaatccgtgaacgatgccacgcagaacagaataagcgcaatcagcgtgcaggtcggaaagctgaaaataccaaccttatattcttcgacattcagcataggctgcgccgcaaagtaaatgaaaaacggaatcatcgcaatgcgggtcagcgtgattttgtttgcggttgtcataggaaattatgcctccttctgacggacaccgagcaggtcgggtccaaggctttcagtaatgagaacggacacgaactcgccttccgccggttcgttatccgccgcgtcaaagtagacgtggccatctacctcgaccgaatccgcgtaggtacggccataccacaggccctgctcctcgtcaaagccctcgcagagcacctgcatgacctcaccgtggcgggaggtattgtagtcgtcgagcacaccggactgcagctcttcgacgatcagacggcggttctgcttggtctcatcgtcgatctggtcgggcagctctgcggcctccgtaccttcctccggcgaatactcgaacacaccgacacgctcaatgccgacattctgcaggaactcacacagctcggcaaactcgtcctcggtctcgcccggcagaccgacgatcaggcttgtacgcagtacaagacccggaatacgctcgcgcatatcctcgatcagcctggtaaattccgcgccgtcacccggacggtgcatggcacgcagaatgcgcttagagacatgctgcagcggaatatccagatactttacaattttcggctcatccgcaatcacgtcgatcagctcgtccgtaatctggtcgggatagagatagtgcagacgaatccaggtaaagtccatcttgcacagctcgcgcagcagctcgggcagcaggcgcttatgctcgggcaggtccataccgtacttggtgatgtcctgcgcgatgacgatcagctccttaacgcctgcgtcagagagcgcacgcgcttcctcgagcagcgatgccatctcacggctgcggtaacggccgcgcagcttggggatgatacagtacgcgcaggtgttcgagcagccctccgcaatcttaaagtatgcggtgtacgagggtgtcaagcggtcacggctgccgtcgagtgcagcagaggtcatatcggccatatacgccgcctgctgccccttgagcgccgcattggccgcgtccacgatgtcatcatagctgcccgttccgcagaatacgtcgatctcgggcagctcagcgcgcatctcgtcagcatagcgctgcaccagacagccggtcacgaccagacccttcatattgccggtctgcttgttctgggcagtctccagaatggtttcgatagcctcggtcttagcggcttcgatgaagccgcaggtgttgacaacgccaacgtctgcttcggtcatatcctcggtgatctcccagcctgcgtcccgcagccgggccagcatgtgctcgctgtccacgaggtttttcgcgcagccgagcgaaataagtcctaatttcggcatgagattctccttcttgtccacattattattctattttattataccgcacaatttcgggtttgtcaccactgactgacggaaaatttggcatagaaaaagacgcagagcaaacactctgcgtctttggaattgcttgattgcaagcagttggttcggtaaggaaaccttacttcagctcaaccttagcgccagcagcctcgagcttctccttgatctcgttagcctcagcctccggagcagcctccttgatggtctgcggagcggagtcaaccttctccttagcttccttcaggcccaggccggtgatctcgcgaacagccttgataacgttgatcttggaagagccagcgtcaaccagaactacgtcgaagtcggtcttagcgtcagcagcagctgcgccgtcgccgcctgctacagcacctgcaacagctaccggcgtagcggatacaccaaattcttcctcgagagcctttaccagctcagagagctccataaccttgagctcttttacagcttccataatctcagcaacagtcatgggattaaacctccaattttagataatttttaagttaaaatgtgttcctgaccgaataaatcagtcagtgcggggaaattactcagcagcttcttctgctgcagcttccttcggggctaccagttcagcaaccttcatttcctcattgccctctgccttcttaacgatagcatcgcaagcaatagcgagctgcataatggggtagttgaagctgtacagtacctgagcgataagggtttccttgctcggcatagcagccagcttcttgacctcgtcctcaccgatggccttaccttccaggtaaccagccttcagggtgaagttctcgtgggtcttagcaaagtcagccaggatcttcgccggagcgacaacgtcgtcggtggtggagattgccagagcggtggtaccgtgcaggcacgcatccagctcgtcaaaacccagttccttagctgcaaagcggatcagagtgttcttgatgacagcatactcaacgccagcttcacggagctgcttgcggagcttggtatcatcctctacgttgatgcccttgtagtcgaccagtacacctgccggagaattcttgatcttctctaccagggaagcgaccagagccttcttctcttccagaatctttgcgttcggcatcattttcacctcctgtaaaataaaagtaccctcccggtgcaaagacacagggagggtacacagaaaacataatcaaatatgataataaacatgtctgtgttgacctcggcgggcggcgaacaaatcgccatttaagccttgcggcgccagctgtctttgaccaagctcatttagtataacgcatatagagcaggttgtcaacacttttttcaaattttttattaaatatcattccttcaggattagaggtgcagtgccggcttttgataccctctgttccgcggtattctctgcgatatgaccattgttttcaactgtaatggtaaattcatcaccgcacataagccgttcaacgggatcgtccgatacatattcctccggagacgcagcactggccagtgaaataatatgagattcaaaggaatgttccccgatagtcaccgaaacgctttcctgtttaacgaatttggcatacagcgatctgacgtgctccttgaatatcggattcacttccgcatccgacttgaaatataggatgatacggttttctttataagatacctgcgcatctgttaataggatatctgctaagctgagcattcccatataattatcctctgcacaatataaatagagcggagagcactataccctccactccaattactaactgctaatttaattaaaaatcagtcgttgatcggaccgtcattccgctcatcaatattaacgtactcgatattcttcgcaacaggcttatacgccggacggatgatcttaccgccggtggtaacttcctcaaggcggtgtgccatccagccgacgatacgcgcggtagcgaacagcggcgtatacagcgacttgggcagtccgagcattttgtaaacaaagccggagtacatatcgacgtttgcgcacatcggcttgtcgctgcccttgatttcggcaaagacgcccggcgtcagcttttctaccagctcgatcaggtccatttcgtccgaatagccggtcttttccgccagcggacgagcagcctttttcagtgcaacggcacgcgggtcgctcaaggtgtaaattgcatgacccatgccgtagatcaggccggagccgtcgcctgcttccttattcagaatcttgcgcagataattgccgacctcggtctcgtccttccagttgtggatattctccttcatctcctcaaactgcttgacgacgcgcaggtttgcaccgccgtggcgcgggcccttcagcgaggaaaccgcagccgcgatcgccgaataggtatccgtaccggacgaagaagtaacacgcacggtgaaagacgagttgttaccgccgccatgctcggcgtgcaggatcagacagcggtcgagcagcttagcctcgtcatcgttgaattcaccggtcggacggatgaggtgcagaatattctctgcagtcgaacgattcggatccggcacatgcaggaacatggaatcgttatcaaagtaacggcgttttgcctgatacgcatgcgaaatgataaccgggaacttggccatcaggctgatgccctgacgcataatgttctcgaccgtggtttcatccgggttcgcatcataggaatacagtgccagcgttgcgcttgccagcttgttcatgatgtcgcggctcggcgcacgcatgatcatatcctcggtgaagttgtccggcagggcacgctccagaccgatggtgtgctgaaattccgccagctgacggcggctcggcagcttgccgcacataagcagataaccgatctcctcaaagccgaagcggttttcctgctccagaccgtgaatcagatcgtatacattatatccgcgataggtcaggcggccttcgatcggctcgcgctcgccctcgttcagaatatagccgtgtacgttgcccagatgagaagcaccgaccagaacaccggtaccgtctgcgttacgcaagccgcgcttgatgcggtagcgcgtaaacagatcaggtgggagctggttgtgcatacaaaagctctcactcagttcatgcaaaagttcttcctttacataatcaggctgaatcgtcattccgccttctcctttccgtcccaataaatcagataatgaatatattgtaccgcaatcctgcaaaaatgtcaatcaacgacacttgtataaaccgacaaaaaccgctttttcgtaggttttccgcttgttcatcctgatatcacgcaagttttttgtgcgcggcgtgcaaagattttatcaatttgaagcgaaaaagtcgtcggcagcgttccttagcaccggctgaccggcacatgcgggctgcgtcagcaagatgccctgccagtgcagaaaatacgcaaaaagtcccctattcgcacacgaacagaggactttctctatcaaatagtcgagattcgcaatttaattacggctccattgcgtgccctggcgggtatccttaatggtaacgcccatatcagccagtacaccgcggatacggtctgcctcagcgaagttcttctccttcttggctgcggcgcgctgcgcgatcagctcctcgatcttctcggcatccgggtcagccgcatcgtcgcggttctgcaccagattgagcacaccggtcagctccatgaacagatcatgcgctgcggtcaggaatgccttagttgcgtcctgatgcgagccgttgtacgcgttgatctcgcgggtcagctcgaagatggcggacagtgcgtctgcggtgttcaggtcgtcgtccattgcatcgatgaacttctgcttgtagcccttcagagcctccagcttctcggtctcctcggcggtcatggtgtcgccggatgccttttcgatgcggaactccatattattgcgggcctcgtacagacgggcaagggaggccttgttcatctcaagcgactcagcagagtagttaagcggagtgcggtagtgcgcgctcagcataaacatgcggatggtttcatagccgaactgcttggcggcatcgcgcaccatgaagaagttgcccttggacttggacattttctcattgtcgatggtcaggaagccgttgtgcagccagtaatgcgcgaaggtgcagccgtttgcacactcggactgtgcgatctcgttctcgtgatgcgggaaaatcagatcaagaccgccggaatggatgtcgatggtcttgccgaggtacttgttcgccatagccgagcactcaatgtgccagcccggacggcccttgctgccccacggcgtatcccaagccggctcgcccggctttgcagccttccagaccgcgaagtccatcgggtcttcctttacctcgccgacagaaatgcgggcaccggcctgcagctcctccatcggctgatggcacagcttgccgtactccgggaaggacttggtgcggaagtaaacgtcaccgttctcagcaacgtaagcgtggccgttctcgatcaggcgctcaacaatgtcgatgatcgcgtccatggtctcggttgcacgcgggtgcacggtcgccttcttgacgcccagaccctgtgcatcaacaaagtattccttaatataacgctcggcgatggtgttgaagtccacgccttcctcgttcgccttgttgattaccttgtcgtcaatgtcagtgaagttctgcacgaactcaaccttgtagccgcggtactcgaagtaacggcgcagcagatcgaaaatgatgaacggacgtgcgttgccgacatggaagtagttgtacaccgtcgggccgcaggaatacatctttacctcgcccggcgtgatcggaacgaattcctccttctgacgggtcagcgtgttgtagagtttcatgatttttatctccttttgatggttttcaggaaagctatgcggagtttcgggaataaaaaagcctcccaggggatattcttccctcgggaggcgtacaaacgcggttccactccgatttttcgctcgtgcagtgcggtaacgggcacttcccgcaaggcgtttgaccctgttgctcggcaggcgcacttcaccgtttcccgcgcaaagccctttcagccgaggagcctctctctttcgcgcaaggcgagccggttacttttcctgcgtcatcgcataaataacgattataatggttctattataaccattttgtgaggagaagtcaagccgaccggtgcagaaggcgttttgacctgttcacctatatagacaaagttcgacaattcatgctataatgaactcgtggaatgcttgtcattccacaggacgctgttgcaacggcggtcagcccttctccctccccacagtctgtgggtgaaaggaggtgagcgcagatgaagaggaaagcactccagctttttatttgtgcggtcatcgtactgtacatcttctttataaaagcgcgatgaccgtccggcggccaccgaacggtcatcaaaaaagttgaccaagtaaagggctgactgctaaaacagcgtcctttttgtacctttattatacgcgcctgaccgctcatttgtcaaggcatactcgtcttacacatgatgaaacgcggtcaaaaaatcatacgcatcgagcaggttgccgatatggaaatccataacctgtgcatccaccggtgagcaccggcagtaatccttgaggttttccggtgcggtaaggccgtgcgcggtcagccgctctatgcttttctcacccggtgccggattggagtccatattgcacagcgccgccagctcaccgcacattttagcaagcagctgctcacagccgcgcagataagccgcctcctgccgtcgggccgccacgcggactgcatgctgccacagcgctaccggctgcttctcgaaaatacgcagctcggacgcaagcgaggtcattttctcagtcagcggcgtcagatccggataacgatgctcgagcacacgcgactgcagcagcggcagaaacattttctggatctcgttcatcatattgatgatcttctgacggttgttatacggccgaatcaccacattgacgagcagcgccaccaccagaccgaccagcgtatccgtgaagcggtggaagccatacacgattgaatctccgccggtatacaggcacacatccgcaaacacgatgctcgccagcggaatcgcaaaattcagcttgagaccgatacacagcgaaatcacacacagcacgccgagcgccatccacacgaaaaacgttggattgggcagcacggtaacaaacacacatgcgatcagatagccgagaaatgtacccgctatctgattgaggctctccttgagtgaatccacccaggtacggctcatcaccgagatcgcaccaatagctgcaaaaataggcaggctggaacccagcaccatcgccagtgcaagcgccagaccgaccgataccgcagtcttgatggcacgctgacctacccgaaaccgtttgataaactgcaacgtcctatcccctttacccctgaataccgtatgtttttaagtgtaccacattctatcggtaaaagccaacacaatcctgtcacacaaagaaaaaggcttcccggccatctgttccgggaagcctttataaattcggtttgattaccgcttacttagcagtgcgctctgccttgcgagccttagcgaaagaacggccgttatccagctccatcatgcgtgcgcttaccagaccattaaagaaacccttcatcatgatatatacaactccttaaaagttaatgactaaattacgtttttgtgtttggatcatttcctgatcacaggtattataatacacgataaccgcctctgttacaagagccatattttatgaatcttcaccaatctaagcgccatctttttgtgcatatttaacatcgtctgtttgcgaagtgtacaaaataaaccattcacgcttgtacgctttacataacaaagctggcaaatcctccaaatcaaacatcctcccctcgaatttccctgcttttttgcgagcagaatctgcgtatcaccttgacttttacggcatttccctatactattatatggtaaaaatttgtttgctacaatatagatacagcgcgaccccaaaccgagcctgacccgcttggtttggggctgctacctgtttggggagagtgatgaggattgaatcaaaatctggtcgatctgcaaaacctgaaaaaagaatttgacggaacgcctgtgctgcgcggcatttcgctgtccatcaagcgccgcgagtttgtgaccctgctcggtccgtccggctgcggcaaaacgaccacactgcgcatcatcggcggctttgagcagccggattccggcgatgtattcttcgacggcaagcgtctgaacgatgttccgccgtatcagcgcgagatcaacaccgtattccagcgctatgcgctgttcccgcacctgaatgttgcggagaatatcgcattcggtctgcacatcaaaaagctggaccgcgcagacatcaagcgcaagaccaccgaaatgctcgagctggtcggcctgcgcggctttgaaaaccgcgatgtgaccagtctttccggcggtcagcagcagcgtgtcgccatcgcgcgtgcactggtgtgcgagccgcgtgtgctgctgctcgacgagccgctcggtgccctcgacctcaagctgcgcaaggacatgcaaatcgagctgaagcgtattcagcagcgcaccggcatcacctttatctacgtcacacacgaccaggaagaagcgctgacgatgagtgaccgcgttgtcgttatgaaccacggcgttatccagcaggtcggcagcccgaccgatatctacaacgagccggtcaacgcctttgttgcggatttcatcggtgaatccaatatcattgacggcgtgatgctcgaggactgcaaggtcgagttttgcggccgcaccttcgagtgcgtggacaagggcttcgagacgaatacgccggtcgatgtcgttatccgtccggaggatcttaaaatcgtttacgccggcgacggtctgctgcagggcgttgttgagtccatcgtattcaagggcgtgcactacgagatgatggttcgcacccaattcttcaccttcatggtgcattccaccatggcggagtcggtcggcaagacggtcggtctgtccgtcattccgtttgacatccacatcatgcacaagagtgcggaggcgcaagcgtgaaaaagtcctttgcctatccctacggcgtatggctcgccgtatttatccttgcaccgattctgatggtcgtggtctacgcgttccacaatgcggacggcggctttacgctgcataatttcagctatctgcccggctacctgccgattttcggacggtcgttctggctggcgttcctgtcaacggcggtgtgcctcgtgctcggctacccgatggcgtatctgatgagccgcctgtccgccagcaaacagagtctttgcatgatgctgattatgctcccgatgtggataaacttcctgctccgcacctacgcatggatgtccattctggagaacaacggctttatcaaccagtttttccgctccatcgggcttatctcgttcctgcaaagccatttcggctattcgctggattatatcccgctcatcaacacgcagggcgcgatcgtgctcggcatggtgtacaactttctgccgttcatggtgctgccgatctacaccgttctcatcaagctcgaccgcaagctgatcgaagccgcgcaggacctcggcgcgccgacccatctggtgttccgccgtgtgatcttcccgctgagcattcccggcgttatctcgggcatcacgatggtgttcgtgccgtccgtgtccacgttcgttatctcgcagatgctcggcagcggcaaaaacctgctcgtcggcgaccttatcgaccttcagttcatgggcggtgcgtacaacccgcatctcggctcggctatcgcgctcgtgatgatcattctcatcttcatctgtatgtggatcatgaacaagttcgatgacggctcctccgaggaaggaggactgctgctgtgaaaaagtttttcaagaacttctatctgctgctgatcttcctgttcctgtacgcgcctatcgttgtgctgatgattttttcattcaacgattccaagtcgcgccgcctgtggaacggcttcacgacccgctggtacgtcgagctgtttcaggatgcggatattctgcactcgctgtatgtaacgctgctggtggccgtcattgccgccgccatcgcgactttcctcggcacgatcgccgccatcggcattcacaacatgggccgcagagccaaggcggcttacctgaccgtcaacaacatcccgatgtcctcctcggacaccatcatgggcgtaacgttcatgctgctgtttgccgccatcggtctggacaagggctacctgacccttatcctcgcgcacgttacgttctgcacgccgtatgtcgtgctcaacgtcatgcccaagctgcgccagctcgacaagaacgcctatgaggccgcactcgacctcggcgctacaccgcatcaggcgctccacaaggtcatcctgcccgagatcatgccgggcatcgtcacgggcgctatcatggcgttcactatgtcaatcgacgatttcgtggtgtcctactttaccgccggcacgaccagtcagccgctgtcggtcgtgatctactcgatgacccgccaccgcatgacacccaagatcaacgccatctcgactattctgttcctgattgtgctcgcgctgctcatcgtcatcaatatgcgccagtcccgcgacgagaagcgccgcgaagccgcccgccggaaaggagcgatgcagccgtgaaaaaacgtatgctttccctgctgctgtgcggcgcgatgtgcgccgggctgctctccggctgcggcaatgcctcctcggcagaggtgctcaacgtatacaactggggtgagtacatcgacaccgacctcatcgaccagttcgaagaggaaaccggcatcaaggttatctacaataccttcgattccaacgaaaacctgtattcgcgcatccagaccacgagctacgacgtcattatcccgtccgactacgcgatttcacgctttatcaacgaggatatgctccagccgctcaattacgatcatattccgaatatgaagctgatcgacgagaaatacacgcatctggacttcgatccggagcagaagtattccgtgccctatacctggggcgtggtcggcatcgtgtacaacaccaagtacgttgatgaagcggatatcggctcgtgggatttgctgtggaatcccaaatacaccaaccgcaccgcgatgttcaacaactcgcgtgatgcgctcggcattgcgctgatgtacctcggctattcgctcaacaccaccgacaaggacgagctgcgcgaggcggctgacctgatcatcgccggaaaaccggtatatcagggcatctggatggaccagattctcgaaaagctgccgagtgaggaaattgtggctgcaccgtactataacggcgatgccgtcaccatgatcgacgaaaatcccgacctcgcattctacgttccgaaggagggcaccaacctgtttgtcgatgccatgtgcatcccgaagaacgcgaagaacgtttcaggtgcggagaagttcatcaacttcatgtgctctaccgaggcggcgatggcaaactgggagtatgtcggctattccagtccgcagaccgaggtctataacgaactggacgaggaaatcaccagcgacccgctgtatttcccggatattacgcagtatccgaccgaggcatataccaacctgccgacggaaatcaaccagttttataatgatctctgggttgatatcttaacgtgatcggatatgcaccaacgcaacgtgcagggcgaggtgacctcaccccgccctacaaatatcacactcagctaacccaaagaaaaagaacgtatccaatgaacagcgctgataacgaagcaattcaaaatcagcgcacaagggccgtaaagacacgaatcccctgctgagaatatttctcggcaggggatttttcgtacatcgcctatttgagccatcggcgctatcttcgtcagaacaaacgctgcttgtatcagtatttgttcttgaccgttaagctggacgcgcatttgcgtgagattgaccatgccgccaacgagatgttcgctcagcttaccaaacagatgacggcagccgaaggtgtcaccgaagcactcaaagcagccggccggatggaatgggtgcgccgcacgaacagcatccgaagccgcgtcagagaaatcgtcaattcgaaactgatttacaactgagtagaacccggagttcagactgccgtttgcggcctggactccgggttcgctttagggcaaaatcgtgcagtatcggtctaacaagcaacggatttgccccagcaaatccaacccgcagggaatttccctgtgccccttattttatcatttacctgtgtgcaatctccacaggaaagtcataatccgcgctctgatgcagcttgcgtccgctgcacaatggcttgcgttcataccgctgacaacacacagtcgctcagaggacagcgtcttcgcggtaagcatcagcagacacatcgacaaaagcggagctgtgatgccctgaagatgccttatcctccgtgaggatactatacttgcagtcacttctgccacgccgttcgccgtgttgtaaacctgccgcttgcaattttactcgaaccattgttgtccaacacgtgcagcagacaaacgtttttgtcggtaacactctgaccgatagtcagcgtgaatccgtattctcgggtacaactgcaccggtcggcgtgatcttattgcctttgccgccaattactatcgctgcaacgtatctcagaggttccgtattcattcgtcggcgttacatttgcatttttgttggtagaaagccgtgttttctcgtcttttactccatgcggagcggctggagcacttcattcatgcgctgaatattctgcacaacgctatccttgcggcgaacagcaaggctgacatacagcgaatcgatcagcgagaactgtgcaacacgcggcgaaacgaaaagctgttccggagaatacagttccaggcagatatcacacacctgcttaagtggcgtatccgggaagccggtgatgccgatggtctgcgcgccgtgctctttcgccgtacggacggcggaaacgatctcacatgtcttgccggtgtgcgagatagcgatcacggcggtattcggcatacacaggctcgcttgaatctgcatcagatgcgagtcggtcagcgacaccgcacggaagccgatgcgcatcagacggatgtagaagtcctctgcgatggtgccggatgcgccgacaccgagaatgaggatgttttcggcgcgactgagcacatcgaccgcctgctcgatcttctggaagtcaagcagctggagcgcacgctcgagcgtgtcgatgttgcggccaaacacactctcggaaatggtctgaatactgtcggtttcagacaaatcttcgaatattgttcgaactgatttgggcgaatacttcgcgagcagcagcttcatctcgctgaaccctgtgcagccgaggatcttgcaaaatcgaataatacttgattctgcgatgtccagctcggcggccatctgctgaatgctgatcgaggtaatatgtaccggatcggctatgatatggtcggcaatccgctttccaaccttggaaaaagtcgcatattgcgactggattgcagcataaacgtttttatccatacgctcaccttttatctgtgtcatattatgttttcattgtaacacaattcttccagtttgtgaagaatgtacaaaaatgaacattattctttttacaagatgaattattgaattttatttcatgcagtgctatacttgattacagtcaatggattagagttccattgaaagggtaaaagctgaagcaagagattacgtccggacaacttctcaaactgcggttccccgaaaaagcacgtttagtgctcgataaagggccgcgcagctccaactggcaaaaaagaaaaataaaaaaggactgagcaaaaccatgggcaaatccagcaacccgactttcgcgggtgataaggaatttgagaagatccatctcaaagaaaagttttcctacggcctcggcgacgttgcctgtaacgttgtctacgccctgacaacctcgctgctgatttacttctacaccaacgtagtcggcatctccgcagcaatgatcggtaccatcatgctgttctcgcgtttcttcgatggtatttccgatgtactgatcggtcatctggttgaccgcacgcattccaagcacggcaagtcccgtgcatggatcctctggatgatgattccgtacggcatcgcagcaatcctgctgttcaccgttccgcctgctacgccgatcgtaaagggcatttacgttttcattacttataacttctgcaccaccgttgtttacaccgcactgaacctcccgtatgcaacgctggcaacgctgatgacccgcgacaccgaccagcgcgccgttgtcaacctgttccgtaccggcatgtccgccctcggcaacatggtcatcaccgcagtaaccttcccgctggttacccgtctgggtgacacccagcaggcatggattgaggtttccatcctctacgccatcgtttccatcatcatgctgttcatctgcttcaagaactgtcatgagcgcgtcaaggaagagaccaagaccaaggacggcaagaacgttccgctctggatgggcatcaagctctgcgtcaccaacaagtacttcatcatgttcttcatgctcgctgtgttcctgtccttctatgaggcagttaccggcacctgcaacgcatactacgcacagtacattctcggcaaccgcgacctgctcggcgcactcgcatcgttcgagtccattccgcagattgttaccgttcttgttctgtctccgttcatcgcaaagttcggcaagcgcaacgtagcgctgatcggtgcggtcgtcgccgttgtcggcacggtctccctgttcatcaacccgagcgccctcaatcttgcactgtttgcctgcgtcatgcgcggcatcggcaagggctgcttccgcggcgtcaagtactccatgctcgctgacgttatcgagtacggcgcatggaagagcggcatccgtgtacagggcctgatggtatctgctaccaccgccggccagaagttcggctccggcatgaccagcgcaatcttcggcggtctgatgagcctcgtaggtttcgccggcaccgtgactatcaacgcagcacagtctcagatgctgatcggtatctacatcatcggcaacatcattgcctggggcggcatcggcgttctgctgatcttctacaagctcgataagatctatccgcgcattattaccgagatgaagcagcgcgaggctgctgaggcagaaaaggccgctgcaaacgcataactcagacatgctctgacactcactaatcatctttttcttcccttatatggcaacagccggcggagtcatgtattctgccggctgcccccttattacgcatggccctatcccggcgcataacaaacttgaaaggcgtgtaacaaacaaatggaaactatgtcctatgaaaaccgtatcgccctcggcaatctggtaccgacgatcggtcagttcaaggtaatggataaaattccgcagtaccagcagtgcgaggtgcacaatctggtcgaggcaccggctgaggtgcccgaggtgctgcgccatgtcgtgttcaacatcgaacgtggtcagacgctgcatgagaccatcgacttcctcaacatgtgtccagacttcaagaacatggacatcatctacgcgaacgagctcgatgacggcgcggttcgctcgggcaactgcaacgtggcgtatgagatcgccaagtccatcggcatgaactatgcctatggcctggagttcatcgagctggtcaacccgaacgacaacaagggtttccacggcaacgccctgttctcgcgctggccgatccgctgggcgaaggtcgttcacatgcccgagcagtacaactggtactatgaccgtcagaagcgcatcggcgcgcgcgttgccattgtctgctcgctcgacatcggcggccgtgaagtcggcgcggtcagcgtccatctggagaaccgcgcggacagcgagggccgcgaagcccagatggcagtcgtgtatgatgagatcaaaaagtcgttcgcgccggacacgccggtcatgatcggcggcgacctgaacaccaatacgtttgacggcaacgacatcccgggcttcaccaagctgttcaacgacccggagcgccttgccaagcacatggcggcggtcgaaaagtacgagcgcgtcctgccgcaggcagaggagaacggcttctcctaccgcgagttcagcagcaccgaaggcacgcgccgcaagccgatgccgggcggcaagagcatgctgctcaagctggactggctgatggcacgcggcatggaatgcgtcgaccatggcacggtctcgactgagacgaaggactgcacctgggccgagccgggcagcgcgctggcgaagttcacaggtcccgagctgtccgaccacaacgcctgctgggcagactgtcgattcgcaaagtaactactaaaatctattgtagaaagctgcacacgctgcatacatattgacagcgtgtgcactttttatcgagtgaggagaacctacatcaaatgagtggaatgatacaatacctgcgcgaacttcatttcgcctcggtcgtagtgcggctcgcccttgcgatgctgctcggcggctgcatcggtctggagcgtggacgcaagcgccgtccggccggtttccgcacctatatgctcgtctgtctcggcgcggcgctgactgtgctgctcagcctgtacgaatttaccatggtgacagggccgtggtcggatatttgcgcagagatcggcataaaaaccgacgtttcgcgtttcggcgcacaggtcatcaacggcatcggttttctgggcgcaggaaccattctcgttaccggccgtcagcaggtcaagggcctgaccactgccgctggtctgtgggcgtcggcctgcaccggccttgcagtcggcgcaggattttacgagtgcgtgctcatcgcattcgcgatgatatttctcagcatccgcctgttcccaattgtggatgcgtacatacaggagaacgcgcgtgacatcaatctgtacatggagttctattcgctcggggacatcagcaccatcatcaatcagctgaaatcgcagaacgtgcagatttacgacatcgatatcgagcggaacaaaagtggcgaggcgctgcacccaagtgcgatcttctcgatccgcctcaatgaaaaaataccgcacacgcagcttctctccgatctggcggagttggactgcttttgcgtgatcgaagagctgtaaggagtggactgctatgttatctgtttttgacggcctgcgcgacgtgacgacgctttccgtgttcgtgcgtctggcctgcgcgctcatctgcggcggcattatcggtatcgagcgctcgtacaagcgccgcccggccggcttccgcacgcacatcctcatctgcatcggcgcggccatcaccacgctgacgagtcagtatctgtatctgaatatgcactattttacagatatggcgcgcctcggtgcacaagttgttgcgggtattggcttcatcggtgcgggcaccatcatcgttaccaagcggcagcgcgtcaagggtctgaccacggcggctggtctctggacctcggccatcatcggcctcacctttggcggcggcttctacgagggcggcattctcgcgaccgtgttcatcatgctcgccgagcttgtgttctcgcgtatcgaataccgcgtgctcgaaaatgtgccggagatcaatctgtatatggaatacgaggacaagcactgtctggatgatgtgcttcagctctaccgcagctgcaatattaaagtgctgaacatccagattacgcgctcggcagaaaacggtgagcataacgcctgcgctatcttttcgctgcgcctgccgcgcagctgcggcgtagaaaagctactgacacttgtcggcaagcgagagggaattgtgtcggtggaagagctgtaaaccacaccgaatttcaaaaaaaacagaaaaccaaagcagtgatgcgcctcgtatttggaggctgcattgctgctttctttcgtttttacccgatgtgccgtcgcgcaagatgaagaaaaatatcgagtcgctgcaaaaaggcagtaagggtcacaggaaaattccctgcggggctgaatttgaacaatcaaatccgttgcttattacgacatcttctacgcaaaaaacgcaatattggcaccatcaaaacaaaccggagcgcacagctgaatttcaggctgtacgctccggtttttgctgcttagattggcgttcgtaaaaatttctaaaaagtttttgtcagtttttgagggcaaagaaggcctgtgaacattatcggaaatttcagcggcggcgcgaacaggaacgatgaggtgcagcatgaacgagttatggactgagcaggaaaacaatttccgaatgaatatcagcggcaccgaatacgaggtgagcacgcattttgacagtagcggcaggcaaagcctgtttgcaggtttgctttactgtccggactgcggcgcgaaacttcattgctgtgcggcgaaaagcctgaaacccaatcaggaattttatcgctgcgccaactacaatttcggacgcggaacgtgcaaaatccactatattcgcaacgtggtgcttgaagaaatcgttctggaagcggtcagcagtctggcggattatgtgcgccgctatgagccggtgtttctgtatttcctcgctatgcagaataacgcggagcatcaaatgaatttgaaagtgctccggcagtccattgacaaaggcgagcagcgtatccggcagatcgacaaggctatcgaagaactgtttgaggccaatatctgtggaaaaatcacggatgagcgctttatcaagatgaccgcaagttacgaaaaagagcagaagaatctgactgcatcggtggagaactggaagttagagcttgaaaacgctcagcagcagaaggtaaacggacgcaaccgagtgaaggtggacatttactttactgccgttgagatagtaaatattccgaccgaaaccgagatgaaagccgctatggaggaactccagcgcagccgcaagcaggcaatcaccacataaaaacagcagcggcacagtccacaaatgggaaactgtgccgctgcttatataatacttcgttatgggtgccgagctaatcggatacgtcccttttttcatgcttatttcttctccagcgctgccatcgcaatcttttccggcgtaataggaagctcatagaaccgcttgcctacagcatttcggattgcatccgaaatcgccggcagcggtgtattgataaccacctcgccgatggatttcgcaccgaacgggccttcgccctcgtagctgttctcgaattccacgcggatcttgccgatgtccacgcgtgcgggaatcttatactggaaaagcgaattttccatcggatagccgcggtcatcgtaggtgacgctctcggtcagcgtcatgccgatgccctgcgcaatgccgccctcggcctgcacgcgcgtcaggttcggattgatgggcgtaccgcagtccactgccgcagcgtaatccagcagggttacctcgccggtttcggtatccacttcgatctcagccgcaccgaccatatacggcggaggcgaaatttcggacgaatgcgtaaccgtcgcctgcagctcgatgctgttgccgttcatggaagccgtcgcaatatcactcaggctaatggtcttgcctgcattttcgccttcctctacgcggacttccctgccgtcgaagctgacctgctcctgatcgcagccgagcagctttgcgccgagcgcacagattttgccgcgcagctcgagcgcgcacttctcggtcgccttgccggtgacgtaggtcgtactcgaggcatacgagccggaatcatacggcgaccagtcggtgtccgcactcagcgtggtaatgttgtcaagcggacactcaagcacctctgccgcgatctgcgcaagcgtggtatcacagccggtgcccatgtcagccgcgccgatgagcagcgtgtaaaagccctcatcgttgaccttgagggtcgcactgccaacgtccatgctcgtaatgcccgagccctgcatcgccatgcccatgccgaccgcgcgcaccttgccgtttcccatgtcgcggcacggatacttgttatcccagtcgatcatgtcgtgcacgcgcgccagacagcggtcgagcgcacagcttgtgttcagctgaccgtagtacgcgggcatgatctcaccctcgtgcgtaatattcatctcacggattttaaacgggtccatgccgaggatgttcgccagctcgtttaccgcgctctccaccgcgaacaggccctgcgttgcgccgtagccacggtacgcgcccgccgacatgtgattggtgtacacaacgtcactcgtaaagcggaatgcctcggccttgccgtacagcggaatcgacttatgaccggacagaccgaccgttgtcgggccgtgttcgccatacgcgccggtgttggacagcgtgtgcaggtcgatgccgcgcacgatgccgtccttgtttgcgcccagacggacgtgcatttccatctcgtggcgcggcgaagatgcaatctggctctccacgcggctgaagatgatcttggacggctttttcgtcatccaggtgacaaacgccggatacactgcgctgaccgcggtctgcttggcaccgaagccgccgccgatgcgcggcttggtgacgcgcaccttgcttttcgggatatgcagtgcgttcgccacgattcggcgggtgtggaacacgatctgcgttgagctgatgatgtgcaggcggccgtaggtgtcgatctcgcagtaggtgcggaaggtttccatcatcgcctgctggcatgcctgcgtgtgatacacgcggtcgataacgacatcgcagtccgcgaggaccgcatcgatatcgccgttgccgcactcgtcgtgcgcgcacaggttgcgcctgttatccgcgccgaccggtgcaaggctctcccagttgtcctccggatgcacgagcaccggattatcctttgcggtgtggaaatcgagcaccggctcgagcacctcgtactccaccttgaccagtttcatcgccttatccacgcatttttcgtccgcaccggcgagaatcgccaccacatcgcctacaaagcgtacatggcggtcgataacaaggcggtcatacggactcgcctccggataagtctgaccggcctgcgtgtagcggcggccgttctggtctacgtcctcccatgtgaagatggcctccatgccggggactttcatcgcggcggtcttgttgatgctcttgacgatggcgtttgcgtgcggcgagcgcagcagcttgacgcacaggcagtcgcgcggcgttacatcgtccacatacaccggctgaccggtgacgagctgcatcgcatcctttttgcggagcggctgattgactaccttcactgtgcgtcctcctctctctgctttttccagtcgagatatgcgcggataccgcgcagctgtccctcataacccgagcagcggcacagattgcccgccagatattccttgatctcctcatcggtcgggtcctgcttttcgcggaacagcgcgattgcgttcatcataaagccgggattgcagaagccgcactgctccgcaccctgatccgcgatgaacgcgccgaattcggcggcttcgccctgcaagccctccaaggtcgtgattgtatgtccgcttgcacgcgctgccagcaccgagcaggacagcaccggcttttcgtccataaatacggtgcacagaccgcagtttgcggtctcgcagccgcgcttgacgctcaggcagccatgctcccgcacaaagtcgatgagcagcgtgtccgccgccacatcgtctgctactttctttccattcaatgtcattgtgatcagcatatccgttcccccttactctgcatcgagcgcgtgtgccgcgcggcgcaccagcacacccgcgaggtgtctgcgatattccgcactgccgcgcagactgctgccggtcttgatttccgcccgaacggcttccgccatctgctccgccgttttatccacaggctgtgcataaatctgtgcgcgcgccggacgggcaccgacggcgaaccgatagccgttctcatccttaacggacgcgcaggtcagcaccggaatgtcggtctggctgatgcgcacggactggtagttgaatttcgcatttttcttgggcacgataatgcgcaccagaatatcgcggtccttgggtctttcggcgtactcggaaagcggcacaatgccgcccttgtacagctctacctgtgcgtccagcacgaggaacatggtcagcacatcggaaaagccgaaccggctgtacaggctgccgccgacggtcgccagattgcgaagctgcacgccgacaatgtggcgcacggattcgcgcatagcaccgttcgtgtaggctgccagtccttcgtgcagctccagcgcgcgcagcgaggccatcgcaccgatccggaactcggtttcggtttcctcgatggtgtccaatcccagaccggacaggtcgattgccgtgccgacattcagcgtctccattttgagccagatcatgccgccgatcacgcggttggactttttctggttgagcgtatacgcttcctcgagcgactcggcttttttgtattcccgtatcgtcaacatacgttatatcctctctctttcaggggaatgtgttatcttttcagtatactacttttattttaccacaaaatctgctataatgccgttgtgaatatcaaaatacaacgaaaagaaaaagttgtgggaaaggagccgccatgcagccaaatatccgcgtgatgctgttcgatgaggacggcgagcgctttttcggtgagggaccgtgccgtctgctgcatgccatcgagcagaccggatcgcttcgcgccgccgcgcagtccatgcagatggcatataccaaggcgctcggactcgtccgtcatgccgagcaggtgctcggttttgcactcaccgagcgcaaaatcggcggcaaaggcggcggcggcagcgtactcactgacgaggcaaaggagtttctctatcgctatgagcagtatcgtgacgcctgcaaacaggcaggaaaacagctctatccgcagtttttccccgatgaaaagtgaaatcggatgtgtgatcatggcatccggcctggcaaaacggtttggctccaacaagctgctcgccgaatttgacggaaaaccgctgctctgccgtgcgtttgccgtgacagaggggttgcaccgcgtagtcgttacccgctcgaccgagatgcaggcattgtgtgaaaaatacggcattcccgtcctgcaccatgcccatccacttcgcagcgacaccgtgcggcttggactggagtacctgctgccgcggtttcctgccatgtccggctgcgtgtttctgccgggtgatcagccgctgctgacgaggaaaacgctctgctgtatggtgtcggcattctgcgcggaacccgaccggaaatcgcagattttccgtctatgcgagccgcaaagcggtacgccgggcagtccggtgctgttcggcgcagattattttgaggaactgcgttctcttcccgagggcaggggcggcggcgcggtcgtcaagcggcatgcggaaagggtaacgctgtttcctgctcgacatccggcggaattgatggacgcggatacaccggacgttctcgcagaattaaaattgatttttcaaaacgattcattttatcggtaatgccaaccatttgatgcggcgttatgcaggcgcacattgtgcgcccctacggttacgtttgtgcagtcggtttacacggtgcgccgaggtcgtcgcaccctacagtatcattttacgcctctctcaatcggaatggcgaatggttgaccgttacgatcattttccatcctcaattctccattctcaattaaaaaccccggaaagaacttctttccggggttttgcattatgcttcggttttcttatccttcgggagcacgatattgagcagaatcgcaacaaatgctgccggtacaataccagaaccgccaaaaatcagctgaaccgcctgcggcgcctgtgccagaatggtcatattggcacccatgccgtagccgacacccagagcaaccgacacgatggtcagattacgcggcgtcatctcctccttggtgatcagctggataccgctgataacgatggacgagaacatcataacagccgcaccgccgagcacggactgcggcataatggacacgatcgcgcccagcttcggaatcagaccgcacagaatgaggaagattgcaccgacggacagggcaccgcggttgacaaccttggtcatggtaacaaggcctacgttctggctgaacgaggtattcggcagtacgccgaacagtgccgcaaacgaggaacccagaccgtcgcaggctacgccgccggacagctccttgtcggttgcctcacggcccatgccgccttccataacgcccgaaatatcgccgacggtctcgaccgcggtaacaataaacataaccagcaccggcaggatggcgcgcagatcaaacaccggctttaccggcatcagcttcgggatggcaaaccagctggcctgtgctaccttgtcccagttgagtacccatgccttggtgaattctacaccgtccgcgtcaactgcggtggtcggcagaacaaaacccatgatgattgccgcaatgtagcccgcaataatgccgacaaagatcgcggacgagccaaggaagcccttgcagccgtgcttgacgaccagaataaccactagcacgaacagcgccagcagcagattttccatcgagccgaaatccttcgcggagttgccgccgccgaaggaattgatgccgaccgagatcagcgacagaccgatactcagcacgaccgtgccggtaacgaccgccggaaagaatttgcgcagcggcttgaggaaaaagccaagtaccgtctcaaacaggccgccgagaatggacgcgcccataatcgcgccatacgcaatcacaccgccgcccatggtagccgcaacgctgttgaacacgccgataaaacccgagcttgtacccatgatgatcggcaccttgccgccgatcgggccgatggaaaacagctgcaccagcgttaccacgccggccacgaacatcgcgttctgcagaacgcttacctgcaggtccgcgaactcgccgcctgcaatgccgcacgcacccatgatgatgagcagcggcgtcaggttgccgacgaacatcgcaaaaacgtgctgcagtcccagcggaatcttgcgcgacaaaggcatttttgcctcaaaatcgtgcgctgcgtccatagaaattttctcttgcatacccacactcctttgtgttgtcctgtaaagtgccgtgccattcattccccttagcaaaacactttctgatttcatgcaaataaattataacaaaaacaaattcctatgtaaatggattgcgcggacagacgcaggattttggaggtatgcgcaaaaatttacgttctgcgacctgtttccttaacattttcccgaatccgcgcaaaaggaaaggaacaacgcacacaggcattgtccctttttgtatcgtttcgaatttctgattaacccagtctttccttgcgctcgcgtccgtctctcagcagaatggtcagttcctcgcggtctcctgcacggatggccttgcggtattcgtcaaggtgcttgatgacctcgtcaatctcctgcgcaagcggctctgcgttgcacaggaacagctcgctccacatggtctcattcagcttggcaacacgcgtcagatccttgtagctgcccgccgaatagccgttgtgcttgtccgcctccggacttttgatgtacgccgaggaaaccacatgcgccagctgcgaggtaaacgcgatcatgtgatcgtgctgctgcgcggtacagcgcacggtctggccgaagccgagcgacatgaagtacgcctccaactgctcgagcacacgctcattgctgctcctggtcggcacaaagatcatgctcgcaccgtcaaacagggtcggcagcgaataatccagaccggagaactcacggcccgccatcgggtgaccgccgacgtagtgcacaccggcgtcaagcgccgcctgctccagatgatcgaccatgaactgcttgacgccgaccatatcgacgatcacgcagccctttttcatcttcggcatattctcgagcagccagtccaccgttgcctgcgggtacagaccaatgataacaaggtcagcctccttgtacagcgcttcggtcgcaatcgcgtcaatcgagccgtcagccagtgcctgctctgcggtcgcgcgcgtgcggttccagcctaaaacgcggctgagtgtgcgcgccttgatggttttcgccatcgagccgcccatcaggcccagaccggcgatgagtacggtatcaaacatgaatgggttccccctgtcttttgttttttattcagttaaagtttataacggcagacagggtttgtcaaataaaattgagaattgaagatggagaattgaaaatgaatgttgagataaaaacttatcacaaagagatgaagtcatcgcgttcattctccattttccattctcaattctccattattttttgggtcttggattaacgctgcaaatccggtgccaaagcggtgtcactctgcacacgataaaaacaagcagcgcacccgcgagattgaggataagatcatccacatcgcacgagcctgttccggtgtacacctgcagcacctccaccgccgtaatgctcagcgtgagcgacgccgtgaagaagaaaatgcttctctgccagcggaacagtgcgggcagaaatacgcccatcggcgcaaacgcgatcaggttgcctgccagattgagcaccacaagccgcagcgagatattgccgtagccgtaggccagcaggtaatttttcaccgtgcggagcggctccagattcaccatatcgagcgaggtatgaccaaatccgcggccgaacgcgttatcgaaaaacagcacattcagcagcacccatatgtagtacagaaacagcgccagcatgtacagccgccgccgtatcggacgcgtattgtccggcacgccgcagaacagcgcagcacgcaaaagcaccgcaaaaatcgctgcaaacacgaatttctgctcgggtgcaacggtgattccgggtgctaactcataatagatgttgaagcacagaaataccgctgtcagcagtaccgctatgccgcgaatcaaattcttcaaaaggagattctcctttgtattggaatatcatagggcgggagtacccgccctatgtcataaattctgttacagactctccgcttccttgagccacagcgcggacactgcgtccgacggcatacgccagtcgccgcgcggcgaaagcgttacggtaccgaccttcgggccgtccggcaggcaggagcgcttgaactgctgcgtaaagaagcggcgcataaaggtcgtcaaccacttcttgatggtcgcatcgtcatacacgcctgcaaaggtcttgtgcgcggcacggaagatcttgcgcggcggataaccgaagcgcagcatataatacaggaaaaagtcgtgcagctcatacgggccgaccagatcctcggtcttctggctgatctcgccgtccttcggcggcagcagctcgggagataccggggtatcgagcacatcctgcaaaacgtcggacagctcaccgagcgtgcggtctgcctcataggcaacaaggtagcgcaccagcgttttcgggatagagccgttcacgccgtacatactcatgtggtcgccgttgtaggtcgcccagccgagcgccagctcggacaggtcgcccgtgccgacaaccatgccgcagttcttgttggcgaggttcatcagcaccagcgtgcgcatgcgcgcctgaccgttctcaaaggtgacggaaagatcatccttggactggccgatgtccatgaaatgctgatcgaccgccgccttgatatccacggtcttgagtgtaacgccgtaggcttccgccagcttttctgcgttgcccttggtacgggcggttgtgccgaagcacggcatggtgacggccagaatgcccttgcggtcgagttcgagcatatcgaatgcgtgtacgagcacgataagcgcaagcgtggaatccagtccgccggatagaccgacaaccgccgttttcgcgtgcgtatggcgcagacgggtggcaaggccggtcgcctgaagcgtcaggatctcctcgcagcgctcatcgcggagtgccttgttcgccggaacgaacggcgtgcgcgggaatgtgcggtcggcaaggtcattttccaccggctcgagcgagaacgagaacacgccgccctcgatagactcgaatgtgttcatgcgctgacgctcgtgtgcaaggcgctggaggtcgatatccgcgtaaatgatgccctgcgagaacatcttgctctcggacagcagtgcgccgttctccgcgatgaggtcgtggcccgcaaaaacgaggtcctgcgtggactcaccgaaaccggcatccgcatacagatacgcgcacagcagacgaccggactgctgacgaacaaggtcgcggcgatagcctgccttgccgatgatctcatccgaagcagacaggttgacgataatgtgcgcgcccatctgcgccagcgcggtggacggcgggttcggcacccacagatcctcgcagatctccacgccgaaggtaaacagcggctgctcatcgcactgaaaaatgctgtcggtcacgagcggtacacagatggcctcgccgtccgcgttcttcacatctacaccctccataccgccggacagggtgtccgcagacacgaaatggcgctgctcgtagaactccgagtagttcggaagatgggttttcggcacgaacgccagcacgtcaccggcatttacgacagcagccacattatacagcttgccgcgcacgcgcagcggcagaccgactacgatgacagccgcaagctctgcggtctcgcggcagaccgtgttcagcgcgtccagtgcgccctcgagcaacgtttcctgcaggaacaggtcgccgcaggtatagccggtcaggcacagctcggggaatgtgatgagcttcgcgcctttggcagcggcctccttcgccagctttacgatctcagaggtattatatgcacagtccgcagcgtgcagatcaggcgttgccgcggcaattttgataaatccatctcgcatcggtgatgctccttccagtggaatagtccagatagagttagtatacctctttttgtacctttgtgcaagagcggctgtaccagacataggtataaaacgcgtgcctatcgtttgaactggcgggctgagggcagcccgccctacggaactaatttagcctctgccgtagggcggggtgccctccccctccgtatgacccatctgcacattgtgtatccgcaggggcgagcaatgctcgcccaggcaacgttgaatcacacgagtcttgggcgcacactgtgcgtccctacgatagaacctctgcaaaccatacacaatctgtcctgcaaaatgatgaaatggagaatgaaataatttcattctccattttcaatcacttaccgatccacaaccggaatctcagactcatccttttcatccagatgctgcagataatgctttgtctctgccgcgatcacgccggagagcagcagcacagcgatcaggttcgggatggccatgaatgcattcagcacgtccgcaatagtccacacaaggtcgagcgcaagcacgggtgcgcacacaacgaccgcgataaacagcaccttatacggcaaaattgcctttttgccgagcagatactcagcggcacgctcgccgtagtacgaccatccgaggatggtggagtacgcgaacgtaatgatgctgaccatcaaaatcagcggaccgatatacggaatctgtgcgaatgccgctgtggtcatctgaccgccgtttgccatgttttccacgctgaccgccggatttttcatcatcgaggagacgagcaccagaccggtcatcaggcacacgacaaccgtcgtccagaaggtgccggtcgcggaaacgagtgcctgccgcaccggattgcgcgtctgcgccgcgctggcaaccagcggcgccgagcccataccggactcattcgagaacaggccgcgtgccacgccgtactgcagcgccagacggataccgccgccgaccagtccgccggtcacagcgcccggcttgaatgccagcacgaaaatggccttgagagccggcagcagaaaatcgtagttggcgcacagaataacgatgcagccgaccacatagaacagcgccatcagcggcaccagtttttcgcacacaactgcaatggattcaatgccgccaataatgataatcgcggtgataatgccgaaaataatgccgattgcgatacgcggcaggctgatgggaaggttggtctccagcacctcggcaatcgcgttgatctgcgtgccgcagccgatgccgaacgaggcgagcatggcgaacagcgcaaacagcaccgccatcaccttgccgaacttcttccacttgaggccgcgctcaagcgcgtacatcgcaccgcccatcatgcggccgtccgcggtctgcacgcggtacttgaccgcgatcaggctctccgcgtactttgtggcaatgccgaacacgccggtcagccagcaccacagcacggcacccggtccgccgagatagatggccgtgccgacaccgatgatgttgcccgtgccgatggtagacgcgagtgcggtcgtcagcgcctgaaactgactgacgtcacccggtgaatccgggtcctttgtcaccgacaggcggatgccagttaaggtcttgcgctggatgaagcccgtgcggaacgtcataaaaatatgcgtaccgcacagcagcaccagcatgggcagaccccagatccagctgtcgattttgttcattaacgcagcaattacttccatgtatccgattccttcctcacttttcttctctttcggacaagagaaggcgcttacccgccattttttgttcggataagcgtcgcagatctatattatatcgaattttccggaaatatgcaagcatattcgtgcatattcgacactttttcggcatttgacgcgatattgcgcgttctcctatcgtatgctataatcgtatcgaattaaaaactatcgaggtgttccctatgaactctgtgaattataaacggctggaaaagagtctgaccgacgtcatccaggaagcacagctcaagattggctacgaccaccacccgatcacgctgtattatcccacggaatccgtggcgcatctgctcggcacaccggaggaggacgcggacagcaccgagcgtgcgctcgcttccctttccgcgcacaccgccgacacacttggcgcaatccaagtcacccgcgatgacaagcgcttctgcttccacatttccgcagaaggcacacagtacgtgcatgaacagctgccggatcccacgtttctgcgtgcatttctgcaggtaatgcgcggtctgacggtcagctttgacgatatttttgcggtgttccatcagttttccgacaaagtgcactgcgagaagctcgagggcaacgaggagtttgactacctcgtatacttcgaggacggcacaccggacagctaccgctactgcatcaagctggatgatgacggtgacgccgtctatcaccgctttacgccggaggattatgcggcgtttgggttctaaatccccatataagcatgaaaaaaggacgctcaaggagcgtcctttctgttttgcggttttactgagcggactcggtagtagccgtctgcgcctcgtcagtcgcggactggctgtcggtcgcggactggtcttcgctctgcgcgtcctcagtctgtgcattgccgtcatcatccgatgtatcgctgttcagaacagtctgcacgtcagccggcagatagtccttggtgttatcataggtgatcttgtcgtaagcctcggtggtctggatgtcagcctcgttgatccactgctgcatcatctcgtcgatcgagccggcagtgcccttttcggaagcaaccgctgcgatgatcgcgtcgcgcatgttctcgaactcatcctgattcagctcacagcgcttgatgatatggtagccgtactggctcttgaccaggccggaaacttcgccttcctgcagagccttggcagcgttgtagaactcgtctaccatctgaccctcggtgaaggtatagcccttggcatactgtgcttcgcctgcatcctcgttcttctcggtcagcagcgcgtcaaagtcctcgccgttgttcaggcgatccagaacagcctgtgcttccttctttgcttcctcatcggtgcgggtggtctcgccggtggacggattcttagtcagaatgaggatgtgctttgcagtgatgtagttgtcatcgaaatacttctgcagctcgtcatcgctcggaacacttacgccgttctcgccgaagtagtaatccttcagcacctgtgcgcatgcgctgacatactggtagttattgtagtggtccatgtcaaagccgatcgaagccaggcgctgcagataagcgtcctcgccgccaagctgctccgcattctgcttgtttgccgtaacaatgttcttcttctggctgtacgacagggacaggcccagctcatccatcttttgcttaacgatatggatcagagcgacctgctgctttgcggactcctttgcggcatcgccgaatgtagatgccatattcttctcagagagaccgtacatagcgtacatctgctgataattgatgatctggctcatcatatagcttgcatactcatctgcgtggatttcctcgccgttgaccgtcataacgaccggtgcatcgcttttcagctcctgataatccaccacaaaggtggatgcgccgtatgcggttgcgctcataacgacagccagcataacgaccagcgcaacgatgcgctgcactaacttgctcatattactatgctcccttttctgtattttacgaacgctatcagtataacactatttcggaacaggcacaagcgaaaacacagaaacatcacaaatttcgctgcccgctggggacgctgccagctggggcacaaggatggacaccaaggtttccacccttgtgaatcccgcttcctttattcctaatctgacgcagaccagagaccggcgaccgcttcgagaaggagaacggcagtcgggttactcttgcgtatctttcgtgaaatattcgcagttcacagatagcttactgctacacagacggtttactctccgcaggcgcgacacaatagtgtcgcgcaactcattggcctggcagctacagacagcacctgcgaatttcatctgatgataaatgttataccgtagggtgcgccgactcggcgcaccttttctaacgaaaaaacacccgtaaaatgcaaaaatggagaatgaaaaccatctggtcaattctccattttccattctcaattactgcaaacaaaaagagaaccgcttccgcggttctctttgctcatttcgcgtcaaacccttgacagataacctcaaacagctcattgatacgctcatagcgtcccttgaggtacagccagccgaacagcgcctcgagtgcagtcgcgtaggcatactctgccacggaggccgacttcggcacggatttcggctttgcgttgcgtccgtgacgcagaacggtctgctcgtcttcatcgagcataggctgaatgcgctttaccgcttccgcctgcgcggacgcacgaacgagctggatcgtacggctgtgcagatttttcgcggtctgagtgccgccgcacgccagatgcgtgcgcacgagtatctcataaacagcgtcgcccacatgggcgagtgcaagactcgtcatgcgggcgatcgcagcgtcatccagcacagggtgcagatgatcggtcattacttgtcctcagcagcctttgcttcagcggcctgctttgcagcctcagccttagccttggcagcagcagcctgcttagcctgcatttccttgaacttggccttctcttcctcggtcggaaccggctcgatgcaacccttcgggcatgccttggtgcacatcttgcagttcttgcacttgtcgtagtcgatcttggcaacgccgtctactacgtgaattgcatcgaacttacaggtcttctcgcacatcttacagccgatacagccgttggagcaaaccttcattacttccggacccttgtccttgttcacgcagttaacgtgaaccttcttgacctcggataccaggttgatgatcttcttcgggcaggtggaaacacacttgccgcaggcaacacacttgtcggtgtcaacctttgcaacgccgtccacaatgtggattgcgtcgaatgcgcaggcctttacacaggagccgaggcccatgcagccaaaggagcatgccttcgggccgcttgctacacgcattgcagcgttgcagtcctgcagaccctcgtagtttgccttgtcctttgcgttgcagccgccgttgcagtaaacgtgtgcaacctgacggtcgccggcagcaacctcaacgccgagtacctttgcgatcttctcagccgcagcagcaccgccgaccgggcagccgtttaccggcgcacggccctctacgattgcagcagccagaccgtcacagcccgggaagccgcagccgccgcagttagcgcccggcaggcactcgcgtaccagcgggacgcgctcgtcaacctctacggcgaaaaccttagcagcaacgccgagcaggattgcgaaaacgatacccatgatgaacagtaccgctaccgcgtaaataacattttgcatatccatttcttgtgtcctcccttaccaaatcgacaggccggagaagcccatgaaggacatagccagcagcgctgctgcaaccagcgagatcgggaagccttcaaagcacttcgggcacttggaagtagcgtccagacgctcacggatggaagcgaacagcacgattgccagcgtgtagccgacaccggctgcaacgccgtataccagagagccgatgaaagaatagctgttggaaatgttggtcttagcagcaccgagcaccgcacagttggtggtgatcagcggcaggaagataccgagcgcagagtacagcgacggcatagccttcttcatgaacatctcgacgaactgaaccagcgttgcaattacgagaatgaacgcgatggtctgcatgtagcccagacccaggggttcgagaatgaagtactgtacagcccaggatgctgcggaagcgatcgccataacgaagataaccgccatgcccatgccgagcgcggtgtcggtcttcttggatacgccgaagaacgagcagcagccgaggaactgaacgagaatgtagttgttgaccaggattgccgcgattgcgagcgacaggatatcggtcaaacccatagaggcaggtaaattaaacacttacttgtcctcctttcgagccatgatcttctggatcgcagccaggatgaagcccatcatgaggaagccgccggccggcaggatcatcatgaccatcgggttggagtggaagaacggaactgcgatgccgttaacgccgttaacgtaaccggacaggatggtgcctgcgccgagcagctcacggaagaagcccatgagtaccagagcgaaggtgaagcccagacccattacaacaccgtcgagtgcggacggcagaaccttgttcttggaagcatacgcctcggcacggccgaggatgatgcagtttactacgatcagcggcaggaacagaccaagggacgatgccagcgacggcaggaatgcctgcatggacaggtcgatcatggttacgaaggttgcgatgatcgtgatgaatgctgcgatacggatcttatccgggataattctgcgcatcgcggaaataacgatattggagcagatgagaacgacggtagccgccgcgcccatgccgatcgcattctgcagagaagtggtggttgccagcgtcgggcaaagaccgatcgtctgcatgaaaaccgggttatcgaggataacgcccgatttcagctgttcagaaaatttcatttggcttttcctccttaacccagagtagcgacatatgctgccgcagtattaacgccgtcggttaccgcacgggaggtgatggtagcgccggtgatcgcattgatcgtgccgccgtccttggccaccttgagctgaccgtcagcagtctgacctgcaaactgggtgatccagttcgggtctgcctggctcttcgcaccgaggcccggggtctcagcgtgagaggttacctttgcacctgcaacggtgccgtccgcattgatgccgacgatcatcgtcaggttgccgccgaagcccttcggctctacctgtacgcagtagccgatctcttcgccgtccttggttgccttgtaaacgccgtcaatctgagcagcggtacggcctgccggcagggttacgccagcggctgcaacgtcctcagcggacagtgcggtgccgagatcctcgaaatcagcgtccgggatgatctctgccattgctgcgttgcgggtttcgataccgttctgggtgatcttatccgcggttacaccgttgataacgcccagcagcagtgcacagatgaacgtgatgaggcccagtacgacgacaagctgtacgatgccgccttcctttttgctgttatccatgatttactgcgcctccttcttagccttgtcaagctgatagccgaacttgcgcggatgggtcttcttgtcgattgcccaaaccagcgtgttcatgatcagaatggagtaggatacgccctccggcagaccgccgaagtagcggatgaataccgtcagcagaccgcagccaacgccgaagatgatctggcccttcggggtaaccgggctggtaacgtagtcggtagccatgaagatcgcgccgagcatcaggccgccggacagtacctggctgagcatccactgtacgcgggaaacatcgccggacagcgggaacaggaaggtgatgacagcaacagtaaggatgtaagctgccggaatgttgatggtgataaccttgcgccacagcaggtaaacgccgcctgccagcagagccagcgcggaggtctcaccgataacgccgccggtctgaccgagcagcatctccagcaggccggtatcagccggtacagcaccggtcttaagggtagccagcggagttgcggtggagattgcgtcggtaacggttacgttgccgaacagcggcaggtttgcatgcggagcagtccaggtggtcatgaaaccggcccaggatgccatcatgaacgcacgggcaccgagtgccgggttcataaagttcttgccgatgccgccgaacagcatcttaacaacgatgatgccgaacagagcaccgaaagcgctcagccacagcggagctgcaaccggaatgttgaatgcgataagtacgcccgtaaccaggcaggacaggtcgcctacggtgttcgggtgatgaacgattttgttgtaaatggtctcaaacacaaggcttgccaccattgcaataacaacatggatcagcgcacgagcgccgaaggtgtaaactgcaaccgccagtgccggaacaagtgcgatgagcacatcgagcataaggctccgggtgtcatcatccgccttgatatgcggcgaggaggttacgactactttgctaagatcataagccattttcgttttcctccttacttgttctctgcgggcttttcagcctctgcctttgcagcagcctccgcctcggcctttttcttttcagcctcagccttggcgcgctctgcagcacgcttagcctggatcttgcccttggtcagacggaactgtgcaaccagcgggatacgagccgggcagacgtaagcgcaggagccgcactcgatgcagtccatcatgccgcagtcaacggcgttgtccagatcctcctgcttgccgtatacattcatgtagatcggcaggagatgcatcgggcaggcgttgatgcacttgccgcagcggatacactggggatccttaacgcgcttatcctcattgcctgcaaaggcgaggaatgcgttggtgcccttgacaaccggggcatccagagagaactgggcgttgcccatcatcgggccgccggcaaggagcttgttcggagcttccttgaagccgccgcaggcatcgatcagcttttcgatcggggtgccgatgcgtgcttcgaggttcttcggctcggcaacagcggaaccggagatggtaacgatacggcggatgaccggcatgccggtggtgaagcggcggtaaaccgcacctgcggtatctacgttgaataccgcgcagccggcgtctgccggcagcttgccggacggaacttcacggccggtgcaggcattgatcagctgcttctcagcaccctgcgggtacttgcaggtcagcggatacagcttgaggcgcggatcatccgcgatcagctcttcgatcttggcgaaggtatccttcttgttttcctcgatcgcaatgatcgcggtctgtacgcccatgatgtcggccagcatcttcaggccgccgatggtctcttccggacgctcgagcagcaggcgatggtcggacgtgatgtacggctcacactctgcagcgttgatgatgaccgtgtcgcacttgccgataccggactggatcttgacatgggtcgggaaggttgcaccgccatggccgacgatgccggcagaacggatgcactcgatacgctcctcattgctcatggaagcgaagtcgtagggatgcacggactcgtgcttgcggtcctcgccatcattttcaattacgatggacagaaccttgctgccgttcggatgcaggcgaggctcgattgcctttaccttgccggaaacggtagcatggacaggagcgctgacaaagccgccggcttccgcgataggctgtcccaggtccacggtatcgccaaccgaaacgatcggctttgccggtgcgccgatgtgcatggaaaccggcaggattacctcatcaggcaatgccagcttctcgatcggcttggtgtttgtcgcggatttatagcccgggtctgcgtgagtacccgggtgtatgccgccacggaacgaatacgccatttctttcacctctctaatattttgcgcaagaagaaccggacgcgcgcccggcttcctcttcttcagaaattggctggctacgcgtgaagcatagccttacagtatagattatactgttttttgtacagtattggcaagaccaaaagcaaaaaaaaatcgaataaaatacagagaaactttgtacatcttgttaagtctatcatttttatccgctttttctttgtgaataacgctcgggttcggtcagtttaaacggatgcaggtattccctttccggcttgcatttttcgcaaaaccggctgaactgcgcgcaaaatgcgaagttttgccctctgccttttgtgcacatttttcgtatactgctattgactttccctttcttcggttataatatgaatacatgaacatatgagcaattgttcatatattatcaaccatcaccgacaggaggcgatccgaaatggcagacgaacacaagcatgaggataccttattaaatgaagaagtgcatgagcacgaacatcatcatcacgaacacgatgaagatgaatgcgactgcggctgcaggcatcatcatcaccacgatgaggacgaagagcacgaacaccaccatcatcatgacgataactgcgactgcggctgcggacatcatcaccaccacgatgaggatgaggagcacgagcaccaccatcatcatgacgatgactgcgactgcggctgcggacatcatcaccaccacgatgaggacgaggagcacgagcaccaccaccatcatgacgatgactgcgattgcggctgcggacaccatcaccaccatgatgaggacgaggagcacgagcaccaccaccatcatcatgacgatgactgcgactgcggctgcggacatcatcaccaccacgatgaggacgaggagcacgagcaccaccaccatcatcatgacgatgactgcgactgtggctgcggacatcaccaccacgatgaggacgaagagcacgagcaccaccaccacgaacattctgcaggcgcgcacagcgtcaagcgcgtttacacgctgcagaatgtcggctgtgcacactgcgcggcaaaaatggagcagcgcatcagcgaactcgagggcgtagaggactgcgttctcgtgtttgagaccaagcagctgcgcgtaaccggtgaaaatccggatgcgctcctgcctgaaatccgcaaaatctgctccggcattgagagtgaagccaaggtcattgcacccaagtccaagcactacggcaaggacggtcagcgcgtttacacgctcgaaaacctcggctgtgcgcactgtgccgcgaaaatgcagcaccagatcagccagctcgacggtatcgatgactgcgtactggtttatgaaaccaagcagctacgtgtcaagggtgacaatcctgatgcactgctccccgaaatccgcaaaatctgctcaaatatcgagagcgaagtcaaggtaatcgctcccgaggaggaaaaggaagagagcagcagccatccgcttgccgaaatgctcatcggtgcagcgctgttcgttgccggtctgctcattccggtcatggctgtcaagctggtgctgctcatcgcggcgtacctgctgctcggccgccacgtcctgctgacggctgtgaagaacatcggccgcggtcaggtatttgatgaaaacttcctgatggccgttgcaaccatcggcgcatgggcggtcggctcgttcgacgaggctgtcggcgttatgctgttctaccgagtcggcgaatactttgaggaccgtgcggttgaccgttcgcgcaagcagatcatggacgcgatcgacctgcgtcccgagacggtaaatctggtcaaggacaacggcaaaatcgaagttattcccgctgaggacgcacaggagggcgacattgttctggtgcgcccgggcgaccgcgttccgctggacggcgaggttgtcgaaggcgaaagccgtctggatacctcggctgttaccggtgagccggttccggttcgtgtcgctgccggcgacaaggcaacctccggctgtgtcaacaccgacggtgcgatcaagctgcgtgtcacccacattctcgctgagagcatggtacagcgcattctcgacagcgtggagaatgcagcggcccgcaagccgaagatcgaccgctttatcacccgtttctcccgcgtttacaccccggctgttgttgcgattgccctgctgaccgccattatcccgagccttgttaccggcgagtggcacaagtgggtctacaccgcgatgaccttccttgtaatctcctgcccgtgcgcactggtgctcagcgtaccgctgacctacttctccggcatcggcgcaggctccaggcgcggtatcctgttcaagggcggcgcttctctggaagcactgaataacgttaagaccattgttatggataagaccggcaccatcaccaagggcaactttgtggtacagaaggtcgttccggcgcagggcgttccgctcgatgagaatgagcttctgtggctggctgccgcctgtgaaggcgcttccacccacccgatcgccaagtccatcatcaactcctacgaggagcgcaaaacgtccgcggcaaaggccggcgacttttctcttgttgccgttggtgcaacggttgagaacatccgcgaacaggccggcgaaggcgttttcgccgagcttgaaggcaaaactatactctgcggcaacgtaaagctgatggagcgcaataatatcgacctttccggctaccacggcaccccgggcagcacggaagtgctgctggcgatggacgatcactttctcggtcatgttgacatttccgataccatcaaggcagatgccaactccgcaatcagccgcatgaaggctcagggactcaccaccgccatgctgaccggtgacggtcaggccagtgcggacgcggttgcgcaggaagtcggcattgacgaagtgcgtgcccgcctgctcccgcaggataagctatcggcgctgaccgatatccgcgagaagcgcggtgcggttatgttcgtcggtgacggcatcaacgatgctcccgtactcgccggtgcagacgtcggcgcggcaatgggcagcggcgcagatgcggcaatcgaggccgcagatgtggtgttcatgaaggccgacctgacttccatcccgatctcggtcaagatcgcccgcaaggcgaatatcgtctccaaggagaacatcgtgtttgcactcgcggtcaagatcctcgttatgatcctcggtctgttcggtatcgcatccatgtggctggccgtattcgccgataccggcgtggctatgctgtgcgtgctcaattcgatccgcatgctgtatatgaagaccgaataacacatactctttgcacctcttatatagaaaggctcccgttccggttggaatgggagccttttgtataccatatagtctgtgctgatacacagggtttccgcctgaaaggcgaacggaactcgcctgcgcggcggtgcgcacaagagggtagaaaccgcaggtgtctatcctcttgcccaccgccgtgggtatggcggttacttatgaaaaacatactcttttctgaaagtcctcggtgccataccaaccgccttggaaaactgcgcattgaaatggctcgggttgtcataccccacctgcgatgcaatccgcgttaccggcaaatcagttgtgatgagcagcgtctgcgcttcgccaatcctgcggcgcagaacatactgcagcggcgaatatccggtcacttccttgcagatatgcgccagatagtacggactgacgtgcagcgcatccgccatctgctgcagagaaaattcgtccgcaaaatgcttgtcgatgtaatccttgatgcgctgtgcaaaggcattgccgctgtgcgtgctgccctcggctgcggtcgcgcggaactgctgcacgagcgtcaggatcgcaagcagaagatgatgtgcaccgtcgtcgttgccctcggtcagttcattgtaaagcacgtcgtacagatgctccagccgcacggtctgcggctcggtcaggcggcacaccggacatgaatcctccgcgatcagcgtattttcgcgcagtccgggcacagccagtccgccaagcgccagacttgaggttgccaccggacgatccggtccggacggctcatcgtgaacgacgcggctgttaaagatgaatagatcgccgcggcgtgcctcatacggcgtgccgcctacaaaatagcggctctcgccgcctcgcacgagtacaatttccactaaatcatcatgcgcgtgcataacgcgcggatgtgccgacgccttctcgtccgtgcggctgaccgaaaacagacgcggcatctgcgtcaggccgaatggcgcttcatattcttttttcacaaagcattgaatcataaaaacgctccttttccctcaatttcgcgtcaaaagcgcctttctgcggcggagatagtatccgtgaaaaaccagccggtcgggatagcaatccggataccgacctcaccgaccggccctgccagcacaaaccagatcaaacctttggcgatactgccttttgtcagatcgcggtacatataatcagataaacttattatagcgctcctgcgatgaaaactcaatgcagcgcttcgcccgctgcggtccggcagggctgcggataacagaaagcctgccacctatggtgacaggctttctctatgctgattttatcgaatcggcagcatcttgccggtctcgaaggattccttgcagcggtaagcagcctcggaaacggcggtgccgtcataaacggtgaggtcagtcggcttggtgttgtcgcggacatggccggtgaaggcagccatctcggctacgaaagcctcgtgccagcggctcatgaagtccggataatactcctcgcgggagccgtgctcatccacgatattcagcaggttctttgcgccgacgtttgcaatgcgcagcgtgccgtgggtgccgatgatctcggtctcgacattgcagcctgcggcatgggtgcggttggtgaacatgaagcccattgcgccgttctccatctggatggtagcagctgcgttgtccgcatcgttcagctccttgtacaggtcgaactcgaatacgccgccgattgcccatacattcttgacatccgagccggtgaaccagcggatgaggtcgatatcatgtacgcacatatcgaggtactgaccgccggagtgcggtgcaaacttgagggtagactcgatggtggaacgcgggtcctgcgtgtaggagcgaaccagaacaaccttgccgatatcgccgttgtcaatcttgcgctttgcctcggcgtaggacttgtcaaagcggcgcatgaagccaagctggaaaatcaagtcgggatgtgcctcgatgaccttctcggcagccttgcactgtgcaacatccgtgccgagcggcttctcgcagaacacgtgcttaccgtggttcatggcaatttcaatctgctggcagtgcaggaaggacggggaaacgataacgatcgcgtccagctccggattcttgcacatttcctcaaaatcggtgtaagtattcggcacgccgagctctgccgcaacttcctttacgcggtttgcatctacgtcgcagatggctgccagttcgcagcccggaacctgcgttgcaaggttcttcgcgtgctcataacccagacgacccagacctaccgaaccaaccttaacagttttcatggtatattctctccttttttatatgtaactctctctctcttacgcggcggttttgccgctctccatttgatgattctattgtagcgtttcgggggctgaaaaaacagagcattcttgcgaaaagaacgcccctatttgcgggatatgagcggggctctcgggcaaactttcaaattcttgcggtcgatgtaaaaaggcagacccgacggtctgcctttacgcttacgttctcagctgacatgaatgacggccaccggacagccgcctgcggcctcctgcgcacccgcctgctcctctgcggtttccggctgatgatggacttcggcaaggccgtcctccgcaatgcggaacacggaaggacaggtcccttcacacagaccgcaggaaatacagccgtctcgttcgattgtaatgtgcataccgatacactcctttcggagattcagtttgccccgtttccgatgatttatgcgtgcctgcgcagaaattcccgtacttcgtctgctgtcggcaccgagggagccgcgcctgtgcgcgagactgcgagagcggatgccgccgaagcctcctgcagcgcggtctgcaccgatttccctgcgctgaccgccgcaagaaagtatccgcagaaggtatctccggcagcggtggtgtccacggcctttaccttaaatgcaggaagctgaaaccgaccttcctctccatcatacagcacaccgtccgcgccgacggtcataacgaccgacgcattcgggtattttgcccgcaaagccgtcagcgtatcctcgaaatctgcatttgcatccgttcccgcaagctgtgccgcttcaatttcattcaccataaacaggctgacgcgcgcaagcggcagtgcatcgaggttttccggcacgggagacggattgaacaccacccgcagtcccttttcatgcgcacggcagatgatctccggcacgaggttgacctcattctgcagcagcacccagtcgtccggctgcgcggtgtcgagcacccgctcgatatactcgctcgtcatgctgcggtttgcgccgccgaacacgataatccgattctgaccggcggcgtttatctcgataacggcatgtccggacggcccatccacctcgcgcagcagcgaggtatccgcaccggattcccgcagcaaatcggccataaagcggccttccgcgccgatcgcgcccgcgtgcagcacctctgcgcccgctcgagccgccgccagtgactggttgagccccttgccgcccgcagccacggcatagtccttcgcggtgatggtctgtcccggccgtacaaactgctccacctgatataccttatctatattcagcgaaccgaaattgatgatgcgcatagcttcgctctccttctctttttctgtcagtatagcatatccgtcctccagccgccactataagcagctttttattggtattttctccaaaatcgctgagttacaattgacttatctgtaaaaaagttctattattttaatatgtttctacaagaaagggaggggacttttttgagtcgtttatccattgaaacgccgggcaaggctgagaccgtcattgccggcttgtaccgcgatatcgagcggcgcatcagcgccagtcctccgggtctgtgtccggtggatatgtcgctgtcgttcctgcgtctgtgccatgcacagacctgcggcaaatgtgttccgtgccgcatcggtctggggcagctgaccactctgctcgagcaggtgctggattccaccgcaacaccggagaccattgacctgattgagaaaaccgcccgtgttattcaggatacggcggactgcgccatcggctatgaggctgcccgcatggttctgcagggcgtgcagggctttcgcgatgactacctctcccatgtggagagcggccgttgcctgttcggctgggatcatccggtgccgtgtgtggcactgtgcccggccggagtggatattccgggctacattgcactcgtgcgtgccggccgttacaatgacgccgtgcgcctgatccgcaaggacaaccccttcccgaccgtatgcggctatgtctgcgagcacccgtgcgaggcacactgccgccgcagcatggtggacgatgcggtcaacatctgcggcatcaagcgtttcgcgtgcgaccacgcggacaacaccacgccgccggattccgcaccttcaaccggcaagcgcatcggcatcatcggcggcggaccgggcggtctgtcggcggcgtatttcctgtcgctgatgggtcaccaggtcgtagtctatgaccagcgtcccaagctcggcggcatgctgcgctacggcattccggattatcgtctgccgcaggacaagctggatgcggatatcgacttcatcctgtccaccggcattgaggtgcataccggcgtttccatcggccgcgatatttcgttcgctgagattgaaaaccagtacgacgcggtttacatctccatcggtgcgcataacgacaagaagatcggcattcccggcgaagacgcagtcggcgtacactccgcggtgcagctgctccgcgacatcggcgagggccgcgtgccggacttcaagggcaagcgcgtctgcgtcatcggcggcggcaacgtgtcgatggatgcaacccgaaccgcaatccgtctcggtgcctccgcagtaacgtgcgtctaccgccggcgcgtgaccgatatgaccgcactcgcagaggagatcgaggaagcacagagtgaaggctgccagattctctcgctgcaggcacccgatcacattgagaccgatgaaacgggccgcgttaccgctctgtggacacgtccgcaggtcatcggtgcctacggcaaggacggtcgtccgcgtccctacgatgctgatcagccgctgctccgcacaccgtgcgatgtcgttatcgtagccatcggccagtccatcgacgcaaagccgttcgagcagatcgctccggtcgtacgcggcaagattcaggccgaatccgatgcatttgtgccgaacaccccgcatgtattcgcgggcggcgatgccgttaccggtccggcgaccgttatccgcgcggtagccgccggcaaggtggctgcggccaacattgacgcacacctcggcttccgtcacgttatcaagagcgatgttgagattccggcaccgcatctgaccaacatgccggcctgcggccgcatcgagctgcgcagcagacccgccgaggagtgcgtcggcaactttgatctggtaaagtgcggcatgaccgagcaggaggttcatcaggagacctcccgctgtctgcgctgcgaccacttcggctacggtattttcaagggagggcgttcttctaaatggtaaatctgacgatcaattctatcccggtgactgtaccggaaggcaccaccattctggatgccgccgcctctgtcgatatcgaaatccccagcctgtgctacctaaaagagctgaacgaaatctccgcctgccgcgtctgctgtgtcgaggtagagggcgaaggcaagctggttccctcgtgcaacaacgtcgtgcgtgaaggcatggtcatccgcaccaattctccgcgtgcactcgaggcgcgccgcgtcaatatggagcttatcctctcgcagcacgacaacaagtgcgcgacctgtatccgctcgggcacctgccagctgcagaagattgcaaacgatatgggcattctgggtgtttcctaccccaccgaccttgcacgcggcaaaaaggccgactggacgaccacgttcccgctctaccgcgatgtaaacaagtgcatcaagtgcatgcgctgcattcaggtatgcgacaaggtgcagtcgctgtccgtctgggatatcagcggctcgggtgcgcgcaccaccattgatgtttcgggaaaccgcgtgatcaagcaggcggactgctcgctgtgcggtcagtgcatcacgcactgtccgaccggcgctctgcgcgaacgcgatgacacgcagaaggcatatgctgcgcttggcgatccggaccgcgtgaccattgtgcagattgctccggccgtgcgtgctgcatggggcgaagccttcggcatgccgaccggcaaggcaaccgtcggtcagctggtgtccgttctgcgcaagctgggcgcagattatgtgttcgacaccacgttttccgccgatctaaccatcatggaggagggcaccgaactgctccagcgtcttcaggcgggcgatctggacaatcagccgatgtttacctcgtgctgcccgggctgggtgcgctttttgaagtcgcagttcccggaaatgaccggccgtctgtccaccgccaagtcaccgcagcagatgttcggcgcggtcggcaagacctggctggcacacaacctcggcgtggacgcggacaaaatttacagcatctccatcatgccgtgcatcgcaaaaaaggccgaacgcgagctgccgagcatggattcggccggtcacggcagcgatgtcgatctggtcatcaccacccgagagctggcgcgcatggcgcgtgccgagcacctcgatgtggaaaacatcgcggaatccgcgtttgattctccgctgggcgacggcaccggtgcaggcgttattttcggcgcgaccggcggcgttatggaggccgcgctgcgttcggcgtacttcctcaccaccggcgaaaatccgtcgccggatgcattccgcgaggtgcgtgacgacggcacgatttctccgctgccgtggcgcgaagcgacgttcgagctggcaggccggactgtgcgctgcgcggtagcaagcggactgggcaacgcacgtcagcttctgcactcgctgcagcgccgtgaggtacactatgagtttgtggagatcatggcatgcccgggcggctgtgcaggcggcggcggtcagccggtggacggcaccgaccgcgaaaaggccgccgaccgcggcaaggttctgttccgactcgatcagaatgcaccgctgcgtttttcgcatgaaaatccggcggttcaggcgctgtaccgtgagtatctggatgagccgtgctcgcacagagcggaggaattgctgcattgcgaccatttcgcatggcagatgaacacttctcgttaagggcaaaaggatagacacctacggtttctatcctcttgactccagtttcccttatttcttagtccggcgcaggtcagagaccggcgaccgctccgaaaaaggggaacgacagaggatttttcgtatactgcggacggaccgacaggtccgtccttttctttacatataagcagttcagatagtgtgctgctacacatacggttcaatcaacgcagcgtgcagtacaaggtgaattgcccgtagggcaagagaaggtcccctgggggatagcagtgccgcacaattcgtcagtccggagattttagacagcacctgcgaggataaattatacccaacagataaattcacaggtgccttccgttataacacaccaaagaattgcgcgacactgttatgtcgcgcctgcgttgattaaaccacctgtgtagcagcaaggaatccggcactgcgtagaggtaacgaaatgggagcacactgtgctcccctacagtagaaaagatcctctgccgttcccctttttcgaagcggtcaccgctctctggtctgcgccaaactgcgaaacaaagggaaacgggagttaagagggtagaaaccgtaggtgtctaccctcttgccccaccgccgtgggtacggcgcctccctcgctgaatctcagcgaaaaactccccgcccgttaggaacgaacacgcctgcgcagttcgcgtaccccatctattcggtgcaaaaaaagacagaaaaacggcacagccaacgctgtgccgtttcgcttatttattcgatattctgtgcgcagataatggaaattttcgaaccctcattactgttttccggctgaatattcttctgcagcaggtctgcgagcaggcgcagcggctggctgccctgccggaacagatcctgtgtgatggtcagatcaagcgagccgtcgagcagcatttgcttgcggcgcggcgacatatcatgtgcgatcacacgcacctgctgatccatgcctgcagctttgagtgcgtccacgcagccggtaacgctgcggtttgccatatagatggccgccggcggattgtctgactgcagcgccgccgtgacgcggttataggtcaaacggtagtcgttataggtctcctcaatctcgatctgcgaggaagagaagccctttttctttagatgctcacagaagccgtctaaacgggtgcggtggccatcgtactccagattacccgccatcgccagcacacgcgcgtttttcggcacgcacttgctgagcagctcggcggcaatacggccgctttgtgtgtaattttgacctacaaagcacagacggcggctgttcggcagatccgagttgaacgtgatgcacggaatgccctgttcggccaattctccgatgcgtgcttcgatcgaaatatcatttaatgcacacagtgcgatgccctgcgcaccccagtttaccagctcgtccagcagctcaatcgtctcgcgcggaatatctgtttcacaagtgcacacacgcacttcaacatcgcgcttttccagctcggaacgcgcagcctggatgcctctcgggacatcctcgtggaacggaccgctccagtttggcaaaagcacacccaaacgcacaggtttgagcggcagctttgcctctgcggcctgccgatgcgcctccttcggagaaagataaccggtctcctgaatggcattcagcacacgtgcacgcacatccgcgcgcacatacgaacgattatttaatacacggtctaccgtgccgcgggaaacacccgcaagctcagcaatcgtttgaatagttggtcttttgttcatagtccttcaccttttcgtaattgctctttatattatcctgcatctctgtgatgtttctttcctctgtgcttattataccatattcctgtgctttgtgaatacaaaatctgtgctttcctgctttctgtgcatttgcacataccgtttttggcacaagttttccgatatatccggtgttttatgctctatttttcatattttccaaaactatgtgcgatattctgggtttttcacagaatgtgtgctttgtacgacatatacaattacacacatcaaaccttgtgaccgcccttgtttcccacatatttgttttatatttctcggtttatacgcattttacgcgcattttatccacttattttgacgttatttccatttgaacgatttccacaccagcaaattacctgttgacacttccgtacccgctcgctataataagcacataaacagcacagagcacacaatcgcacagtgctgagagagacaagagaagaaaaacgagaaaagaaagggagacacactatgaaaaagagactgttagcagccctgctcaccagcgccctcgcactcagcctgaccgcttgcggcggcggcaccgattcttccgcagccgacggcggcgacaccgcctccactcacgacggcccgtacaagatcagcatggtgctcaagaccaacgctgccgagttctggaacattgttcaggcaggcgctgaggcatatgaggatgagcacccggatcaggtcagcctggacatcaagggtcctccggctgagacctactacgaggagcagctcaacaccatccagaccgaccttgcggttgagtcctacgatggctacctgatcgctccgctgcagtccgaggctgttgcaaccgctatcgcaaacaccgacaagccggtcgtagcatacgatacccgcattgattccgacaagtgcctcgcattcgtcggcaccggcaacaaggaagcagccaaggagggcggcaaggccgctgttgaagctgcaaaggcagccggctggaccgatatcaagtgcatcgagatcgcaggcgttcagggtgacgcaaccaacaccgcccgcatggaaggctaccgcgaaggcgtaaacgaagccggcggcgagttccttgatgcagagacccagtacgctaacgcaactgctgacctcgctgtaaccgcgatggaaggcatcatgagcaagtatccggaaggcgttgccatcatctgctccaacaacgacgatatggcgctggcagctgcccgtaccgcaaaggacaatccgaactatgcaaaaaccatcttcctcggctttgacggccagaagtccgcagtagaagccgttctgaacggtgagctgaccatgaccgctgcacagaacaacttcgacatcggctacaaggcagttgagaccatcgtgaagatcctgaacggcgaggagtacggcgacgtagacaccggcaccgagatcatcaccaaggacaacgcacaggctcgtctggacaacttcgcagactggctgaaataattccttgaaatgcacgcatttcagggagatgggaaacaccgcggctttgccgcggatgattcccgggcgaaaatcagcgcgtcgcacagcggcacaccgattttcttacttgtaaaaaaacgcagatacatgctccgcgtttttttgtgaaggcaacgccttcacgatttaacaccgcttgcggcggaaattatgtatggaaacgcgctccaacgcttcatacaaaacctctctttttattccaaatgttcatttaaggagaaacacccatgaaagtaggtattatcggtgcgggtcgtatcggtaaggtacatgcgaagaatatttccatgttcgtaccggagatggagatcaagaccatcgctgacccgtttatgaatgagcagaccgaggcttttgccaagtcctgcggcattccgaacaccaccaaggacgcaaacgacattctgaacgatcccgagatcgatgcagttctgatttgctcctctaccgacacccattccaagtacatcatcgaggctgctcacgcaggcaagaacatcttctgcgagaagccgatcgattatgatctggagaaggttcacgctgccatcaacgcagccaaggaagccggcgttaagctgcagatcggtttctgccgccgcttcgaccacaaccaccgcgcagtttacgacatggttcgtgacggcaaggtcggcaaggtcaacatcatcaagatttcctcccgcgatccggagccgcctccggtatcctatgttaaggtttccggcggtatcttctacgatatgatgatccacgacttcgatatggcccgcttcctcgcaggcagcgaagttaccgaggtaaatgcagttggttccgttctggtcgatccgggcatcggtgaggccggcgacgttgataccgcgctcgttaccctcaagttcgcaaacggcgcgatcggcgtgatcgacaacagccgcaaggcagtttacggttacgaccagcgcgttgaggtattcggctccgaaggctgtgccgaggaccagaacgacaccccgaacaccgctgttctgtccaccgcagacggcgctgtacacggcgtagcctacaaggtaatgtgggaccgctacaccggcgcattcgttgccgagatgcaggcgttcgcagatgccgttatcaatgacaaggagactccggttaccggcgaggacggtctgtatccggtactgatggcagctgctgctaccaagtctctgcacgagggccgtccggtcaagatctccgagatcgaggcttaatcacaacttaattttcacaccacgcacacagtctaagcaatgtgctaaaaccgttggtgcgctatgcaccaacggtttttctatgcaaatttgagggagttagaacagagaaaatgttattcacttgcgtaacctttgtatttttacgattttagttgcggtcatctcctatgttaagaccaagggcgatgaccagaccaccgctgacggctactttctggcaggccgcggtctgccgggtgtcgttatcgcaggctcgctgctgctgaccaacctttctgcagagcagcttgtcggcacaaacggccagacctgggcgattggcatgagtccaatggcgttcgaagtaatggcggccaccgcactcatcgtgctggcgctgttcgccgcaccgcgctacctgaagagcggcatcaccaccatcccgcagctgctcggcgagcgctacgaccgacccaccaagctgtggttctccatcgcttacattattctgtatctgttcgtgcagatcccggtaatcctttactccggttcgctggtgtttgaaaacattttcaatctgtccggtatcctcggcattaccaagttccagtccatcgttatcctgtgtatccttatcactatcatcggctcgatttacgctatcttcggcggtctgaaggctgttgcagtatcggataccatcaacggcgtgggcctgctgatcggcggtctgatgatcccgttcctggcactcaacgtgctcggtcatgcctccggcagcgagagcagcgtggccatcctggacggcgtgcgctacctcgttcacaaccacgcagacatgctcaactccatcgctcccgcacagagcgaagcaccggccgttccgtggccgaccgtgttcctcggtctggtattcctcggcttccagtcctggtgcacccaccagtcgttcatccagcgcgtactcgccgctgaaaacctcaaggaagcacagaagggcgcactctactgtgcattcctgaaaatcctcggctttatgttcctcgctctgccgggtgttatcgcttacgcgatcttcaacatcgagggcacgcaggtttccatgatggacgatgcctacccggcactcatcacccgcgttgtaccgcagccggtcatgggcttcttcgccgctgttatgttcggcgcgatcctgtcctcgttcaactcggttcttaactcggtcaacaccatgttcaccatggatatctacaaggaattcatcaacaagaatgcaagcgagagcaagctggtttcggtcggcaagaacatcggcatcgtgttcgccatcttctccgtgattgtcggtccgatggtttacttcttccctgccggtctcaagaccttcctcgactcgttcgttatgctggttggcctgccggttctgtccggcgtattcggcggcttcttcttcaactgcctgccgaagtacagcgcccgcttcatcatggtgttccacatcatctgctacggcggcttcatgctgctgtccccgagctactcgctgttcggcggcaatgagggcagcatccactacctgtacgccgtatctatcctgtggccgctcgagatgctcatcatgtacctcatgcaccgccgcaacaagagcaagggcgctgaggtttgggtgcagcaggatgtcggcgcggtagacctgaccccgtggaagtacagcaagctggtcagcgtgatcgttatcgtgtgcgtgctgctggtttatctggcattctctccgctcggcatcggagcataatttttggaaaacagcgttgcatatccgctgcgcttgatgtatcatcaatttaaaagagtaagacaaccgaaacaagaaaatttggaggtaatttattatggcactgagaaaatgcgcttgcatcgacaccctttacaccgagctggactggctcgaccgtttccaggctgcaaagaacgacggctttgaggccgtagagttctgggactggcgcatccgcgatctggatgcgacccgcgaggctgctgagaaggccggcattgcaatttccggcttcaacggcgacgcggactactcgctcgtagacccgacccacaagcagaagtatctggactacctgaaggagtccatcgcggcggctaagaaggttggcgcagccagcgttaccatccactccaacgcactgggtgacggcggcattgtagtaaaccactacgacaacctgtcccacaccgtaaagctgtgctcgatgtacgacacgctgctcgcctgcgctgagctggccgaaaaggaagagatcaacctcaacctcgaggcgctgaacatcaccaccgaccacgtcggcaacttcctcgctaccacccatatgggcgctgaaatcgttcgtctgatcggctctccgcgtctcaagctgctgtatgatgtataccacatgcagatcaacgagggctgcatctgcgataccatctccaactacggcgacaccttcggccacattcacgttgccgatgctccgggccgtcatgagccgggcaccggtgagatcaactataagaaggttatccgtcacctcgaggagtgcggctacaccggccgtgtcggctatgagctgttcccgctgaccgataccgcaaccgccgttaaggccatcatggaaaacgcctaaatctctctttccttcaagtccctgtgctgtatggtacagggacttctgttatactatgaggcaggcatatcgaattcgcaaatcaaaatcttcaaccgcatcctgcatttccatgctataataaagctgcaaagataaaaacgcaacgtgcactccgtgcaccagagccggtaggtagcccggccgtcctgcttttgcagggtaagtaacctgcccctccgggttgtccattctttgttcatttatttttcaggagggaaaaacaatggacaaagtaattggcagactgaccgtattttttgaggacccgttctgggtcggtgtattcgagcggatcgaaaacggcaggttatccgcggcaaaggtaaccttcggcgcagagccgaaggagccggagttgctgatgtacctgctgcggcactactaccgattgccattcagtccggctgttgagactgccgtaaagcctgcacaccgcaatcccaaacgggcacagcgggaagccggacggcagaccgcgcaagtcggcatcggcaccaaatcgcagcaggcgctgcagctccagcaggagcagaacaagcaggtgcgcaagcgccggagccgtgcgcgcaaacaggccgatgccaaacggctttatgcactcaaacagcagcaaaaacgcgaaaagcacaaaggacattagtcctttgtgcttttcttttcgcttagaggaacccgagcaagtgctgcatcgcgatgctgacgcacgcgatagcgacccagcagcagaaacccatgaaaattggcttgccgccggtcttgaccagctttacgatattggtattcataccgatagccgccatcgccataacgataaagaacttggacagcgtcttgagcggcgtaaacacgcctgccggtacgccgaccgtggtgcacaccgtggtgatgatggacgcgagcacgaagtacaggataaacatcgggaacgcgcgcttgagcgagaaggcttcgccgcccttgctctgctcggtcttggccttgtgggtgcgccacagcgccagtacgagcgtgatcgggatgatcgccagcgtgcgcgtcagcttgacgatagtggcgatttccagcgtattgctgccgtggatgccgtcccatgcggaagcggctgccgttacggacgaggtatcgttgaccgccgtgcccgcaaacaggccgaagccgtggtcagtcatgccgagcatgccgccgagcgtcgggaaggtcagcgccgcgatgacgttgaacagaaaaataaccgaaatcgcctgcgcgatctcctcatcgtccgcgccgatgaccggagcggttgccgcgatcgctgagccgccgcagatggacgagccgacaccgaccagcgtcgagatattggacggtaccttcattgccttgcacagcacgaacgatacgatcagcgaggtgctgatggtcgaaacgatgatcggcagcgactgtgcgccgacctttgcaatctcggacaggttaagaccgaagccgagcaggataaccgcgtactgcagcacctttttcgatgtaaaaccgatgcccggctgcaccttggtcttgttcttccagaacagcgtgagcaccatgccgatcaggatggagaataccggtccgccgacaaccggcaccgcctgtcccagcagccacgccggaatcgcaatgcacaggcacagcagcagtccggcgccgtttttcttgataaaatccattatttgacccccttattaaaccgaatattagtatacactatttctgtcagtcagttcaatactcagttcgtgcagagggaaaaagaaatcagcctgcaggctctttgcaggctgattgggactgtttagaactgatacggcggatttccggagaaatcagcgatactgccgtgtgcatcctcgagatagaacacctcaaagatcggattggtcgcctcgccgtactggctcttgacgatcgggttctggatgcacatctccttggcagccatgttgttctcgaaaacagccttgccgtgcaggcgaatccatgcgtactccgggctggaaaccgagatttcgatctccggattgctctgcatgtccttgtaaacgtccttcgtgttgttcgtgcagaaccacagcttgccgtccatctcgcccgagaacatgaacggacggcactttgccttaccgtcacggcctacggttgccagatactgtaccggatttgcctgcagaaattctacgaccttgctcatgataaatacctccatgaaaattttattttctttttctatattgggattgcttttcccttttggtgattctataataaagccgtagtgacaatctgtaaagtaagcacaatattgtggtgtaattacccaaaagatactattggcgcaaatcgcgttaacaaggaggtttttctcatggaactgaccgaatcgactgcaaaacaggagctgcccgcctgccctgtcgagaccacactgacgctcatcagcgataaatggaaggtgctcatcctgcgtgacctgatgaacggcaccctgcgtttcggcgaactgaaaaagtccatcgggcacgtcacgcagaaggttctgaccgcacagctgcgccagatggaggccagcggtctgctgacgcgcaaggtctatgccgaggtgccgccgcgtgttgaatacacgctgaccgaactcgggtacagcctgaaacccgtgatggacgccctgtggaaatggggagaaaattatcaggcacagtgccgttaaagcggcatcaaacccgcaaatcgaactttcaggaggaaaatcatgcctcatattttaatgatcgccaccggcggcacgattgcatgctgtgagaccgcacacggtctttcccccgctctggacagcggcgcactgctcggcgcactgcccgaactgtctgcgctgtgcacagttgaaacgctcgatctcatgcagctggactcgaccgacgtgaccgccgccgaccgtcagcgcatggcacaggcggtctggcaaaaccgtgagaaattcgacggctttgtgctcacgcacggcacggatacgcttgcgtacaccgccgcgctgctcacccacctgctgccgcatttcgacaagccgctcgtgctgaccggctccatgctgccgatgggcgtgccggactcggatgcgccgcgcaatctgctggatgcgttccgcactgcggcagacggacgcgcaggcgtgtacgccgtgatgaacggtcaaattctgcacggcagccacgttttcaagcagcattcgaccgagattgacgcatttctctcggcaaatgccgcaccggcaggcgaaatccgtgagagtgaagtacactggaacacacctgcgtctatcccctccggtgaaccgaaactcgtagaacaaatcgatacccacatcctttcggtgcgcctgacccccgatctcgacccgtcattcttctccgtgctgctcggctaccccaaggtcgtactcgaagccttcggcgcaggcggtgtacccgcccgtttggaatccgctgtgcgcgacctgatccaaagcggtacgcgcgtgtatatcaccacgcagtgcccggaaggcggcgtgcacttgcacaaatacgaggttggacgccgtgccgaagcactcggtgcgatttctctcggcagccgtaccttcgaggacgcgctcggcgcactcatgtgcggtgaattgtaagatgttctgcccgcaaagtacaataaagtcagaatagccagccgtatagaaggacttcgcctgtccaacggggcagcctgtccgaaatcgcacaaaaatcccgccttctcacgcgagaaagcgggatttttctttactgtgcattctccttgctgaacggcagaatgtgcatccgatacttatgcttatcgaccagcagcgtgcggtcagcgatcggcatgatatccgaaaccttatccggcggggtgcagatgatcgcctgcagacccattttgcgcagcagacgcacgctttcgatgatgcgttcgctgtccatcttgttgaacgcctcatcgaacacgaccagacgcacggtgttgccaaagctggacgtatcgctcacgcggtacagctgtgcaaacgacgccaggaccgcgatatagaacggcgtctgcgtctcgccgcccgacttggtgttgagcgtctgcgacagcagctgcttggagccgttctgatcggtggtttccagatcgaacttcagataggtgcggaagtcggtgtaccgctcgatattctcctgcagctcactctgcttgcgggcgttgagctggacatcgtctgccatggtgatctggctgaacagcttgtcgatcagcggaccgtatttctcctgaaactgtgcggaaaacagcgtaatatcgccttccatcagctccggcgccataatcatgtcgtaatattcggcataatccggattgcggtccacgcggaactggtagctgtccgtgccgaactgcgcctgccgcagtgcccgattgaggttcttgacctgatcctgcacctgctcgatgctgcttttcagcctggacaggaagtcgttctggaactgctccatcgcactctcgcgtgcggcacggattttggtacggtactgcggcagctcgctttcctcgagcacacggcgttccgcatcgaactccgcattgtcgtctgcctccacgcggaacgagcacggccccaaccgctcgacatattctcggcgcgcccgcaggagtgccgcgcgggcgttctccatctcgttgacaacctgtgcatggtggctgctgaaattgcggtacacaatatccggccggtgcagacgctccagctcctgccggtagcgcggcagaccgatatcgtcgcggtaggtctccgagaaggtttccgccagcctgcgctccatttcggtgcgactgcggtactgctcgggcaggatttcctcgtccagctgacgaatacgctcctccagcttggccttgtgtgcgatctgcacctcgcgctgacaactcagcgccgcaatctcgtcgctgatctcggcaatcagctgcttctgctgatccagccacagcaggtcgagatgggaaacctgctcgtcgatcgcgttgatctcctcctccagttccgcgcggtacagaaaatccgcctgccgctgcggtacgatgtttcgcacataatatggtgtcagcatgggcgctttctgctgagaaactgcctgccagatgggtttccggtgcgaaatctcggtctgcagaccggcggcctcctcctccagacgagcgatacgcagcgtgaccgcatgacggccgatgaacgcatcctccatacggtctctgcgaagcgcacgcgccacatagccctgatacagcataccctcatccgtgatggcggtccgatacccgcgcagctgctcaaccgtgtcgcagcacatcacgcgcccgagcagataatccatgtaggttcgcgcaagcgcgtttccggtctccaccttttccgcaagactgccgctctgcgggtcgatatgctcacgctcgcgcagcgtgccgatatcgaccagaccgtaggcgttcaggctcttttcccacttgagtttgttgtaaatacgcaaagcctgctcgtaatatgccggttcaaccagaaaataaaacttttggttgttgagatagccttccacagcaccgcgccagcgctcatcttcaatttccagcacatccgcgagaatatctaccgcaaccggcgttcccgcctgctgctccagttcctccgccagcttggcacgaaacggcagcagtccgcgcggatagtccttgatgttcctgcgcagatcggcaagcgcagtctgcttttcggtcagctgctgctgcagttctgcaaccttatcgccaagctgatgcgccgccttcgccagcgcgtccgacagggccgctgccgcctgccgggcgtcctcgaatacggtctgctcctgcgagaagattgcgcattcgccgctcgacagccgtgcgtaggtacgctgcacctgctctgccgcctgctgcaccggaatgagcacctcctcggcgtcccatgcaagcgcggtctcgcacaggtgcgtcagccgcagcgcctcccgcttgatctcaagtgcgtcgcgctccatctcctgcaccagcttgctctgctcggtcagcagcgactgcttctggttgcccagccgctcgcgctcctgataggtgtcgctctgggcataatcgcggtccagctgacggcggcgttcctccttcgcctgcacctgcccggccaaatcctcaatcgcggtgtccgccgcggtcagctcggacaggcagtttcgcttttcctgctcgcggctgtcgatctgcgcctgcatgtcctccttctgcgcccactgcacaaggaaggactgcacgcgccagcggtccaccgagcgcgtcatttcgcggtacaaagtgctgatctcctgcagtgcggtcagcttttcctcctgctgctgcgccagctgctcgtgccgcttgtagttgcggatgttctgctgcatggcttcgatatccggcttatccggaatatcgcagatattttcggtgataaactgctgaatatccacgattgggcggaacgacaccgcctttttcatcatgcggagcacctgctcgttgtgcacgttccaccgcgagagcatattgcggcggtactcccactgggtatcgtacacctcggcgcgggagaaattctgcttgaggaatttgcgcaggtcgtgaatatccatcgcctcgccgtcctcgacaaagcagttttccggcagttttccgacatagataaagaaatgatcgtgcttgctgccgtcactacggcaatcgaacatcacgccgcacacgaaactattgtgctccacatcgtcctcaaattcacagacaatataggtcgaaaagtccttgcctctgcgggaatacgggttattctcgtccatatcggcacgcagatagccgtccagcgtgcgctgtgagcgctcattggccgccagattgaagttgcgcgcattggtctcaccaagcagaacgatctgcagcgcatcaattaccgtggacttgccggcaccgtttttgccggtcaggaagttcacgtcaccgacctcgatgacctccttgctgaaatacagccagttaatcagcagaatcttcttcagtttcttcatcggcggtctcctcctttcgcagcacggctgcgacctcattcaatcgttcgctcgaaacggcagtctgaatggtcggcaggatggcaaatctgcagtcagcctgattaaattttccctcgatgcgctgcagaatcgagtggttttcaaacacggtcagcgcccgcttgacctcctccatattcggcttagccggcaggatggcgtagtcggtcacgatcttttcgagcacctcgcgcacgctgcaaagcgcgtcctgctcgagtcccagtcgctcctgactttcgtcgtacagcatgcgcagggcgagcagaatcgcggtctcgcgcttggacaggatgcaccggttggcttcatctgtgttcagcacataaaagtagccgtttatgtcgtcgcgccgcaaatcccagtcaagcaggctgagatactcgcgcacggactcataatgaatggacaaaaaggtgtagtccgggttgctcacccgtcccctgcccggacggtacagcgtgcgcaccacataggtgcggctgagcagctgattgcacaccgctttgaactgctccagctcctttgcggtagcggtattcagaaattccaaattcattcgttgttctccttccggctgatctgcagctccggaatagcatagccgttttcccggcgttcgccgtccagctcctgcaccgtgaaatccgccgagcggtcgccgccggtcagcaccgccagcaggctcatcacatagtccttatcattctcgagcggaatatcctccgagcggcacacatcgctttcaccgagccagccctgcacatacgccgcgatggcgccgcggccatactccgagcgcaaaagtgcagccgcctttgcggcggctgccgtatccgcttcggtctcctgcacgagcacaggcgcggcctttgtccgcttgcccggacgcttgcggtaccacaggctgctctcggacaggcaggtctgctcatacagccggaataccggctgaatcgtgtccaccagatcggcggcacgccggttgcgcgacagcgcggtcagcaccgtgtgcagattgccgcggatattctgatctcggttggtcaggttttcgatcttctgcgtagccgcacgcgtgtagcggcgcacctgtgcatcgatctcatccagataatcgcgctcgagattgtcgtagcactcctgtatccagtaaattttgcgaagaagatcggcgcggcagttctccggcgtgtcgcctcggcggtcagccaaggcggcattcgccatggcgatgagcagttcatcgttctccgcccagtcgtttaatacattctggatggaaatgcggtatttcggcacggaatccttgatcttgagcggacggatgtacgcctccatcaccttctgcccgaaatcatcaaagtgcgatgcgagcacttccccgacattgtgcatgtcgatctgcatctggaaataatgcttgacgttatgatacaccatctgcagcaggttgatgagcgcgcgcgtgttgtcatatgcgccgtagacagcagccattttgtcatacacgttgtccgactcatgcgcgaccttgagcgtggaataggtgccgaacacatacgaatagccgcgtgcaggcgtgtcctcgcgcagcgcgtggaacagctcgagcagacggctgctgcagcccgggaccgtaatgtattcccgaaaatctgtgccgcgctccttttcaaaccagcccttgctgcccagcttgcggatgaggaaacgggcacggccggaaatatcgcgcagctcatcctcgtcgatgtcctcgccctcgaaggtagcttcggccagctgctgctcgagacggctccgcagcatggaatacagcatgtcctcgggcagcttcagcttttcgcggtacgccgtgtacagcacatcgagcgcatccgcgtacagcgcacggttcggtgacgccagcggcgaaaacagctcgtccggcacggcttcaaaaaatttcatgtcctctatcctcctctgcggcgcaaaacgatagattcggcacgcaaattgcttttctatacaaaaatattatacaattttcgaggaaaaattacaatgatgaaatccgtttcccgcgtattgcgccgctgtccgccgcatgataagataatgctgtaaccctcatgcaaggagaatcctgtttcatggcacaaacaaaacacaaggaaatggacatgctgcacggcggtctggccggaaaactcattcttttcgcgctgccgctggcgttcagcagcattctgcagcagcttttcaactcagcagatgtggccgttgtcggccggtttgcgggtgatacggcgctggcggcggtcggcagctgtgtggcgctcgtcggtatttttgtcaacctgatcgtcggactgtcggtcgggccgaatgccgtgctcgcgctgctcatcgggcagaacaaccgcgaagagatcaaccgcacgctgcacactgttatcacattcggcgcggcgctcggcgtaggactgatgattgtcggctggctgacggcaaagcccattctcgtgttgtccggcacgccggaaagcgtgctcgatcaggcgctgctgtacatattcatctactttttgagcatcccgttcatgctggtgtacaacttcggctcggccgttctgcgcagctacggcgacagccgccgccccatgtactacctgcttatctccggcacggtgaatgtcatcctcaacctgtttctcgtcattgcgctgcagcttggtgtggccggtgtggcgattgcgaccgttatctccaatgtgctgagcgcaggcatggtgctcacccaccttgcacgccggaatgacgatttcgcgttccggttccgacgtatgcacattgaaaaaacgccgcttctccgcattctgcagatcggcattcccgccggtattcagggtgcaattttctcggtatccaacgtatttatccagagcggcatcaactcattcggtgaaaatgccatcgcaggttcatctctcgcactgaattttgagtatttcacctacgatattgccaacgccttcgcgcaggcggctgtcaccttcaccagccagaactacggcgcaggtgacctcagtcgctgcaaaaagattttccgttactgcatgctgttcggcgtggtgtttaccgagattctcagtgcggtattcatgatctgggacgacttttttgtcagcatttacaccacgagcagcgccgtcgcggcgtttgccatcagccgcatgcggcacgtctgctcgctcgagggtctcaccgccacctatgaggtcgaaagcgcggcgctccgcggcatgggcaaatcgctcgagcctgccatcttcaccgtgctcggcacagttgtattccgactcatctggatggcgacagttttccgtctcgtgcccacgttcgagatgctgatggacgtttacgttgcctcgtgggtgttcaccggcggagcgctgctgatcgtctatctgcggcatatgcgaaaggtttcgcacgcataacttcagaaagcacgaaaaccgaggtacacgccccggttttcatgcatttgcttcgcaaataatactatttcatgtgcgctgccgcgcggcagcgtcagcatcgcgaaaacggactttattgacagactgaccgcaggtgtcccttccttttcgccccagctgcgggtgcggcaaacccgcgatagattatcgcataataagatacactgtatagacagcatacgttgctaccatggcgatacccggcacacgtccgagcttgcccttgcgcgccggcagataaaataccgcgctgatggcaatcaggaacagacagtcaacgatagaggtcgcctgtaccggaatcggcgtgatgaccgacgaaacgccgagaatgaggaaaatattaaacaggtttgagccgataacattacccatcgcaatatcgttctgacccttgcgggcagcaacgatggaggtaacaagctcaggcaggctggtgcccatggccacaatggtcagaccgatgagcgtttcactcaggccgaacatacgcgcaatgccggtcgcgccgtttacggccagctgaccgccgatcacgatgcacgccagaccgagcaggatattcacccagatcatcgcagcggacatgggtgcttccgcttcctcggcctcggcttctgcagctgcggcagcaagctgctcgcggttctgcagtgcggtgcgaatctggtatgtcaggatgaatgcgaatataatcagcagtacaacgccttcccagcgggcgatggtcaggtcgggtgcgatggcgcccagcagcagcacagccgcgagaatggacagcggccagtcacggcggagcagcgttttatccatcacaagcgggcagacagcggcggacagaccagccaccatcagcagattaaaaatgttcgagccgacaacattgccgaccgcaatctcgtttgcaccgcgcagggccgcggtgacactgaccgccagctccggcatggacgtgccgaacgcaacgatggtcagaccgatcagcagcggtgatacgcccagcttgcgcgccagtgcggatgcacccgcaacaaacttatccgcaccccagatcataagtgcaaagccgatcaccagaaatacaaatgacagcatacagtttcctccttcgtttccggaaaatctcggacagcaccgctccttcacggcaatgcccttgtccccaacagtgtacatgcttacgagggagttttcgctcgatttccggctgcagagcacaaaaaaagacttttaccgcatactgcggtaaaagtcttgctgcttacggctcggtacggattgacttttcgtcaatcgggcttgtcggcaccgaccacgcgctctcgcgtgagctactcccttttacagtaactatcatatgggaaaaaaagcgattagtcaagccgaacttgtggaaatgtacacaatctttacgggacagccccttatagcagttcagacaaatactacaacaagtgcgcgcatacagcacgcaaatagcatcgtcaatttcattcgccatgcgcctagcatggcttcataaaatttccttgctctttacgcgctgtatacgttacttttgctgcattatttatctaaactgctataattcacgaaaaaatctttacaagtccctcgtgaacctatatactataaggtactgaaattttgaacaatctgaaagtgaaggagcattttcatgctggaatttgaggaatacaaggtcaagctgaacaacctcaagcccgagcttgaggagctgtacacctcgctcggtctggagcaggcgaagcgtgaggtagaggagctggagatcaagtcctctcagccgggtttctgggataatccggaggagagccagaagatcgtctcccgcatgggctcgctcaagggcaaggttgaagcgtacaacaagatgaccgagctgtgcgatgacctgctcaccatctgcgaaatggcgattgaagaaaacgacgaatccatgctcgaggagctggaaagcggctacaaggagctggaagacggcattgccgagcagaagctgcgcacgctgctgaccggcgagtacgacagccacaacgcgctcgtatccttccacgccggtgccggcggcactgaggcgcaggactggtgcgcgatgctgtaccgcatgtacacccgctgggcagagcgtcacggctttacctataagatcatggactatcaggatggcgataccgcgggtatcaagtccgccgatattctcattgagggcgaaaacgcctacggcttcctcaagggtgaaaacggcgtacaccgtctggtccgtatctctccgtttgatgcatccggccgccgtcagacctcgttctcggcggtagaggtcgttccggatattccggatacctccacggactttgagatcaagccggatgattacgaaatgcaggtttaccgttcgtccggtgcaggcggtcagcacatcaataagacctcatctgcggttcgactgattcacaaggcaaccggcattgttgtagcctgccagaccgagcgaagccagctgcagaataaggaaaactgcctgcgcatgctgcgttccaagctggttgagatcaaggagcgcgagcatcttgagaaaatctcggacatcaagggcgttcagcagaagattgaatggggcagccagattcgctcctacgttttcatgccgtatacgcttgccaaggatacgcgtaccggctttgaaaatgccaatatcaacgctgtaatggatggcgatattgacggttttatcaacgcatacctgtctgcactcgctaccggcgtgtgggaaggcagcaagggcggtaatatgtaatttaccgcacttcgcgttaccgccgtacccacggcggtgggcacaaggatggacaccaaggtttccacccttgtgaatcccgtttcctttatttcttagtctggcgcagaccagagaccggcgaccgcttcgaaaaagaggaacgacagaggatttttcctctcataaggacggacctacttcgggtccgtccttttcttttacctattcgcagttcggttaccctactgctacacatatcggctactctacgcaggcgcgacatgcctgtgtcgcgcaattcgttagcttggaaattaccgacagcacccgcgaagataaattgtgccaaacagacagattcgcaggtaccttccggtataacgcgttcaaatgttgcgcggcactgtcatcccccagggggaccctctcttgcccttcgggcaattcaccttgtgccgcgcctgcgtagagcagccgacatgtgtagcagtacgctgtctgcgaactgcgaatatttcacgaaagacacgctgtggtaacccgactgccgttccccttttcgaagcggtcgccggtctctggtctgcgccggactacgaaataaaaggaagtgggagttaagagggtagaaaccttggtgtctaccctcttgccccgccgcggggcgcggcacgttcccgccgtccgcagacggcgaatccccgcacagtcggtgctgaaaaggttccacccggaaaatcccgcttgctgaaatttccattttgacaaatcccgcgcattccgcgtgatacaataacactccgcggcaccggcatggaaccattcgattatccacaagtctgtggataaatccgtgcaaaatcacgccgcaacggaggagtttttacgcagacagcagttttcaccgcagcggctaaaacaaacgcgcttccgctgcgattttacccgttacgcaacaatatcgcgctgtgcacgctcggtgcagacgaacggccgctgaccggtcacgatgaagtcacctcggtggaccgcagtctggtgctgagcagcaccgccgtccatctcggtgagcacggcagcatccacgacctcgccgaaagcgaaatctaccgctgggccaacgtgcgcggctacgttgcactgcaccgcacccagcccatctatcttagcgaaaaccgctgcatgatgcacctgcggctgaccggtgtgcggctcggcatggagcaggtggtagtctacacccggctttccggcggcatggcgcgtgtagaccgactgtggcatcccctgtccgaacaggaaaacgacccgtccgccgccgtgtttgccgccacagccgctgctttaacagctttataatatcagcaatttgcttattcacaaaaaatttatttatatcctgtccactttatgctataatactatagtatatgtaacaaatggggctattgcgcccttttgaaaggctgaagaaaagtaatggctaattttttgaccaaaattttcggcacgcactcgtcgcacgagctgaaaaagatctaccccattgcggataaagtggacgcactcgaagagcagttcaaaaagctgaccgacgacgagctgcgcgccaagacagacgaattcaagcagcgctaccagaacggcgaaacgctcgaccagcttttgccggaggcatttgccacctgccgtgaagcagcatggcgcgtactcggtatgcgtcattaccgtgtacagatcatcggcggtatcgtcctgcatcagggccgtatcgcagagatgaagaccggtgaaggcaagacccttgtggctacccttcccgcttatctgaacgcactgaccggcaagggcgtacacattgtcaccgtcaacgactacctcgccaagcgagacagtgagtggatgggcaaggtataccgcttcctcggtctcaaggtcggtcttgtcattcacgaggttccgccgcaggcccgcaaggcgatgtacgccgctgatatcacctacggcacgaacaatgagttcggtttcgactacctgcgcgacaacatggcgatctacaaaaatgcaatggttcagcgtgaccatgcgttcgccatcgtcgatgaggttgactccatcctgattgatgaggcgcgtaccccgctgatcatttccggtcagggcgagaagtcctctcagctgtacgagattgctgaccgctttgccgctcagctttcctgcctgcgcgtcaaggaagtggatgccaaggaggagcaggatgacatcgatgccgattacatcgtcgatgaaaaggccaagaccgcaacgctgaccccgcacggtcagaagcgcgccgaggcttactttaaggtagaaaacctgtccgaccccgcgaataccacgctgcagcaccacattaaccaggccatcaaggcacgcggcgttatgcagcgcgacgtagactacgttgtccgtgacggtcaggtcatcattgttgatgagtttaccggccgtctgatgttcggtcgccgctacaacgagggtctgcatcaggcgatcgaggccaaggaaggcgtaaaggtcgagcacgagagcaagacgctggcaaccatcaccttccagaactacttccgtctgtacggcaagctgtccggcatgaccggtaccgcgctgaccgaggaagaggaattccgccacacctatcagctggacgttatcgagatcccgaccaacaagccggtagcccgtaaggacaatccggatgcggtttacaagaacgaacgcggcaagatcatggcgaccattgcccgcattgagcagtgccacgcaaagggtcagccgattctggtcggcacggtttccatcgaaaagtccgaggaactgagcaagatcctgaaggccaagggcatcaagcacaccgtcctgaacgcaaagtatcacgagcgcgaggcagagatcgttgcacaggccggcaagccgggcgcagttaccattgcgaccaacatggcaggccgtggtaccgatatcatgctcggcggcaacgctgagaccatggcgctggatgaaattaagaagtatctccgtcacgagatcgaggaccgtgtgcagaagggcgagatggacgagcgcgttgcgcacgactacatcgaccatatgatctacgaggcaaacggtcatgccgatactgacgaccaggaggttctgtctatccgcgccaagtttgaggagctgtacagcaagttcaagaccgagaccgacgcggcagccgaaaaggttcgtgcggcaggcggtctgtatattctcggcaccgagcgccatgaatcccgccgaatcgacaatcagctgcgcggccgtgccggccgtcagggcgaccccggcgaatccagcttctacatttcgctggaggacgatctcatgcgtctgttcggctccgaacgtatccagaacatgatggacaccctcggcattgccgatgacgagccgatcgaccagaagattctgtccggcgcgatcgaaaatgcccagaagaagattgaatcccgcaacttcggcgttcgtaagcacgttctcgagtacgatgacgtactgaacacccagcgtcagaccatctacgcacagcgtctgcaggtgctcgagggcaaggacgttaaggacaacattgtcaagatgatcgacgataccatcgcccatgcggtgcatgctgccatcggcgaacacagcctgatttcgaccgaaatggttgaacaggcgcgccgtccgttcatcggcgtattcctccgtccggaggactgcaccttcacgcccgaggagtgcgatgacctgaccgctgaccagctgaccaacattctgtccgatcaggcgcacaaggtctacgaagccaaggagcaggccctcggctcgcctatcatgcgtgagctggagcgcgttgtactgctcaagaacgtagacagcaagtggatggaccacatcgacgctatgaccgaactgcgaaacggcatcggcctgcgtgcatacggtcagtacgatccggttgtcgagtacaagcgcgaaggctttgatatgtttgacgcgatgatcgactccatccgcgaggataccgtccgcatgatcttccttgcacaggttcgcacccgcgaggaacccaagcgtgagcaggtagccaaggagaccggcgcagcaggtgcaaccgacggttctgtcaaggcagagcctaagcgtgccggcaagaagcccggcccgaatgatccgtgcccgtgcggcagcggcaagaagtataagaaatgctgctacctcaagccggacgacccgtataaataactgtcgcgaaaccggactttattgacagactgaaacaggagagaaccgaggttctctcctgtttttatttagttgaacgcttcatcattttgttcggcgaacatgcgctgcacacggtcgagcaggatgggatatccggcgagtgtcggatcggcagacagcagcgcttccgcttcctcgcgggcgttttgcatgagcgcgaggtctgccgctaaatccgcaacgtgcagtgcgggcaggccgtgctgccgctgaccgaaaaagtcacccggaccgcgctgcgcgaggtctgcgcgtgcgacctcgaagccgtcgccggtcctgcacaggatgcgcaggcgctcccgcgcgacctgtcccttgtccgcgccgaagaacacgcagtacgactgccgtgtaccgcggccgacacgtccgcgcagctggtgcagctgcgacagaccgaaccggtctgcgtcctcgaccaccatcagattggcgttcggcacgtccacaccgacctcgataaccgttgttgcgaccagaatatcgtatttctgcgctgcaaaatcgcgcatgatctgatctttttccgcgtttttcatgcgtccgtgcagtacagccacgcgccggtgcggaagcagcttctgcaggtcttttgcatgctgctccgcgcttttcagctttgtttccgcattttcgctgtcctcgatgagcggacacacaacgtaagcctgtccgccgagaccgacctgcttatcaatgaaggcggtaatacgcttgcgcatgttttcgcccacggcgtaggtctcaaccggacttcttccgggcgggatctcgtccagcacggacacatccagatcgccgtacatgatgagtgcgagcgtgcgcggaatcggcgtagccgacatgacgagcacatgcggcgagccgcctttcgcgctcagcgcggcacgctgcgccacaccgaaccgatgctgctcatccgcgataacagcacccagccggtggaactgcacaccctgctgaatgagcgcgtgcgtgcccacgaccacctgcgccgcaccggtctcgatggcggccagtgccgcacgtttctgcgcggcagtcatcgagccggtgagcagcgtgcacgagatgcccagcttgtccagcataggtgcaagcgtctccgcgtgctgcgcggcgaggatttcggtcggcgccatgaaagccgcctgccagccgttctgcgcggccagcgcacacaatccggccgctaccactgtcttgcccgagccgacatcaccctgcaccagccggttcatcggccgtccggaggcacagtccgccgcgatctccataatcacacgccgctgtgcaccggtcggcgtaaacggcagggcttcaaagaacaaatccaatccattcgaggtaaaaacaatgccggaatccgcctttcgacgctccttcagctgctgcagaccgcagcagagcaaaaacagctcctcgaataccatacgtcggcgtgcctgcgccacatcgtccttggttttcggccggtgaattgcagaaagtgcgtctactgcgtccggcaggcggtatttcgcccgcaaaagttcgggcagcggatcgggccattcaccggtcagcgtgtcgagcgcggcagcggttacacgctcgagatcgcgctgggtcagtcccgccgtcagcggatagaccggcacgatgcgtcccgggtggtcagcgtccggtgcgaccttctccgactgcggtgaaaccattgtgcggccgcgcccgaatccttgcaccttgccgtagaacacatactcctgtcccacgcggagctgcgccgcagcatacggattgttgaaataggtgacgttcagcgtgccggtttcgtcgtaaatcgtgcacttgaccagcgtcagacccttgcggatacggttgaccttgggttcagtgccgaccacagcgcgcacagcatacttgtcctccatgtcgatttccgcaatcggcgtgatgtgagtgcgatcctcgtagtcgcgcgggtaggtctcgagcgcgtcacgaagcgtgcggatatgcagtttttcgagcagcttcgcctttttcgggccgatgcccttgacgaactggatgctgtcatcaaccgatggcatgaggattctccttttggaattttgatttgcaaggcgcccgctttacggggtgcacgaaccgcgcaggcggttcgccctaacgggcggcaccctttttctgcaccggctgagcggggcacgcgaactgccgcaggcgggttcgcccttgacgggcggcagctttttcctgcaccggaaagccggggcgcacgaactgcgtaagcatgttcgccctaacgggcggagcgtttttcgctgacattcagcgggggattcgccgtctgcggacggcgggaacggtgccgcgccccgcggctggggcaaaaaggaagggacacctgcggtttcccttcctctttgaactcctacctttcccttatttgatagcctgacgcagaccagagaccggcgacagcttcgaaaataagagtacgacagaggattttttctaccgtgtctttcgcaacctgttcgcagagtcagataacgttctgctacacatgtgggtttatctacgcagggcgcggcacaaggtgaattgcccgaagggcaagagagggtcccctgggggatagcagtgccgcgcaattcgtgagcacgttattatagacagcacctgcgaagataaatagtatcaaacgcctaatccataggtgccgtgcggtataacacgttaaagagttacgcggcactgtcatgccgcgcctgcgcagatgaaaccgtctgtgtagcagtacactgtctgtgaactgcgaaaaggtggagaaagacacgcaacggtaacccgactgccgttccccttttcgcagcggtcacatgtcggcaatctgcgccagactatacaagggaaaggggtgattcacaagagggtggaaaccgcaggtgtctaccctcttgtgcgcccgcgcggcgtcagcgcacgtcccccgctcagccggactgaaaaaagctgctctcaatactcgcggtaaaccgccttgaccacgcccaaaatctggcatccggtgccgttgatcggcggatacgccggattctccggcatgagccatacgccgtccggcgtgatgttgagcgtcttacaggtagcctcatcctcgagcagcgcgatcacgatgtcgccgttgcgcgcctgtatatcctgccggataatgaccagatcatcatccataatgcccacgccgatcatcgaatcgccgcgaatacgcagcgcgtaatactcgccgccgcccgctgccggctcgaacggcacatagccgatatgctcctctaccgcgaggatcggcataccggcggtgacgcggcccagaatcggcacgcgcggcaccatggaagggccgctgaccggcgtcagcgcacgcgatttatgctcattcggctccagataaccggcctcctgcagctttttcaggtgcgcatgcacggtggacggcgaccgcagtcccatctctgcaccaatctcacgcaccgaaggcggatagccgtgttcaagggaataactgcttatataatccagtatctgctgttgtttggcggaaatcttcttcattttcggcactcctcgctgtttccgtcggaacatacgttcgtaattttatccttattataccgcaatccgctgcaataagcaaacatttgtttgcattaacctgcacgaattttccgcgttaatcgacactattcttcaatttatccatttttctgccgccgtgttgaaaaataacgcagtttcatcaccgcattgcttgtattttacatgattttgttatatcatataaacagcaaaagtattgattattgcggggcagacgcattctgccttaactcgcagggaggtttttatatgaccatcaagaccgatctcggatatatcgacattaccaacgaggtgctggccggcattgctggttacgcagcatcctcctgcttcggtgtcaaaggcatgaccatccgctccatgtcggacggactggcacacctgctcggactggaaaatcagtcacgcggcgtaaaggtcaccgaggctgtggacggcggtgtcaacatcgacctgcacattgcagtcgagcacggcgtgaatattgccaccgtctgccgctctatcatcggcgaggtacgctatcatgttgagcgcctgaccggtgtggacgtaaagaacgtcgatatctatgtagagagcatcaaggcggactgacacctataggggacttcgcaagtcccctatatacggaagtcagttccgtagaaactgacttccgatacccgaacgacgcgccccaagggcgctgagtcggagtaacaaaacccacgctcatgtcgcgggttttgttgcggcataacgccgctgtttgaattccgcggtacaaccgcggacgtctgcggacggaaccaatgactcggattaccctaaggaaatcctgtcatgcgtttacggtttgcaagcaaaccgaaatcttattacgcgcaactgcgcggttacttttaggagagttagataaatggcagatcagaaaatcaacggtgcgctgtaccgatccatggtaatcgagggcgcactcgccattgcagaaaagaaggaacaggcaaacgaactgaacgtattcccggtaccggacggcgataccggcacgaatatgtccatgacgatgggttccgcaatggctgagatggaaaagctcgccgagccgaccctcgccaaagcggcggatgcgaccgcttccgcgctgctgcgcggcgcgcgcggcaactcgggtgttatcctgtcgctgctgttccgcggcatggcgaaaaagctgcgcgagaccgacgaggccgacggccgcacactcgcgcttgcgctgcgcgagggcgtagacaccgcctacaaggcggttatgaagcccgctgagggcaccatcctgaccgtatcgcgcgttgcggcacagcacgcggtcgagctgtgtcaggccgagccgacgctcaccgcagagcaggttctggcagcgatcatcgagcagggccacaccgcacttgaggaaaccgttcatcagaatccggtgctcgaaaaggcaggcgtggttgacgccggcggcttcggctttatcaccatcttcgagggcatgctggacgcgctgcgcggcatccacaaggaacgtgctgttgcggcagagccgaccaagtccaccgcagacttcgctgcgatcaacgacgaggacatcaccttcacctactgcaccgagttcatcgcatcccgcaaggacaaggcacgaaatgttgctcgtctgcgctccattctgaacgaaatcggcgattcgctggtggttgtcgaggatgatgatatcgtcaaggtacacgttcacaccgaccagccgaacaaggcgctcgaggagggcctgaaattcggtccgctgttgaccgttaagatcgaaaacatgcgcgagcagcacaccgccaaggtcattgagggcacagcggatgcgcccaaggagcgcgtgatcgtccccgcagagaagaagtttggctttgtagccgttgctgccggtgagggtctcaaaaccctgtttaccgaccttggcgcagacgttgtggtacagggcggccagaccatgaacccgtccaccgacgacattctgcacgctgtcgatgccgttccggcggaaatcgttttcgtgctgccgaacaacaagaatatcatcatggctgccgagcaggcggttcatctctccgaggagaaaaaggtgatcgtcgtgccgaccaagaccatcccgcagggtatttcggccatgctggcggtcgatctggaagccgagcaggacagcgagctggcgcttgctatgctggacgcggcaaagcacgtccgcagcggtcaggtgacttacgcggcccgcgacagcgagtttgacggcaagaagatcaagcagggtgagtatctgtcgctgtgcgagggcaagctgtgcgccaatggcaaggaaacctcggtcatcaagaagctggcgcgagagatggtctccgacgacagcgcgtttgcaaccgttatcttcggcgaaggcgttactgaggagcaggccgctgaggttgagaacctgctgcacaaggaaaacaaggagatggagatcaacgtcatcgacggcggtcagccggtttactactacatcatttcggtggagtaaaccatctccctaagcataaaaaagcatcggaaactgcgtttccgatgcttttttcgtgaaatttcgtctgctgtgatttattttacaagctcagctgccatatcgaacatggtctgtgcatccaaaccggtatcgaagccgctgataaggtaggtcacgccgtcctgctcccagagcacggactggaacattttatcctccacctcgtctgagccatagctgataacaagttcgccggacttctcctgctgcttttcctcgtcagactcctcgtaatcggccggaacgaagcggtagtgcgcatcgcgataggtcagcgtaacaccgtttacctcggcagtcgttgccggaaccggattctccatctcgtcctcggtgaacacggtgtagctcttgtgcgcggacagattcagcttcgcgccatccttcgtataggttgcatccacctcgctgactttttcggtctcgcccatgtcattccgtgcggtggtatccacatcagagccgtagctgaacgtatactcgccaatcttgtccggcagcgtgagcgctacaccggcatcagccagatgcgcctgcgtgctcgacagatccagccgctggtcagaccagccctgactgaaaatgccgcccatgccgccggcggcgaatgcgccggtcaccgcaatcgcagcgacagcggcaaccgccacaaagcgtttgctccacagatgacgcttgcgtgccggtgcattgttcagtgcgaatttgacgcgcgcctgcatcgaatccggtgcatgcagctcatctgcacactggtgcagcatttccttgatttcacgttccattttgatttcatccatgatttgcagcctccttcggcttccgttcttcggtcagcgcctgccgcagatgacggcgagcggaaaaaaggcgggatttcaccgttccctcggtcacgccggtcgcctgcgcgatctcgcgcaccgagcgatcatcgaagtaatacagcaccacggtcacgcggcgtttttcgtccagcgtatcgagtgcagcatacaggcggcgctgctcatccgtccgcagcacggcggacagtgcgctttcactctcgcctgcgtcaaaaaactctgagaccggcgtttcccgtttggctttgcggcagtacttccatgccgcacgggaaagcgttttgagcagccacggccggaatttgctgccgtcccgcagcgatttgatggactgcgcacaggtgacaaaggcctcctgcgccagatcctcgccgtccgtcctgctgccggtgatcaggcacgcaaggcggtatgcatcgtccttgtagcgctcgtacagctcgtcgaacgcctgcatatcgccgtgctgcatgcggctgacaagctctttatcgttcataactttctatcctttccctgggtgcgtctgtatataagagcagccagtttggactcggttcattttattttcagtgaaatccgcgtccttcgacgcacccgagtataagagccgcaaagcggcatatcggttcatttttatttaacggacactttgtacagttttgacggttgcgtttaacgtggatgtattctatactggatgtatgaatatgccagtgccgctgactccagcggggggggggcgcctgcccggcgagggcacaagaaggagacaacctgcggttttctccttcttgtgaatcttcctctttcccttagagggcacggcgaaaatcggagagacgagaccgctccgaaaaggggaacggcagaggattttttcttccgtaggggagcacagtgtgctcccattcccctgcctatacgcagtgtcagatactctgctgctacacatgcggttccgtctccgcaggcgcgacacaaggtgaattgcccgaagggcaagagaaggtcccctgggggatagcagtgtcgcgcaattcgttcgtctgaatatgacggacggcacctacgaagataaactgtaccaacacctaaattcgcaggtgccttccggtataacacgttaaagatttgtgcggcactgtcatgccgcactctgcgttgattataccgcatgtgtagcagtaatctatccgacactgcgaatatgcggatacatggacgcgcaaagcacgtcctgcggtagaagaaatcctctgtcgcgtccttatagtctcagttcactaattttcgccgtgctatccccaagggaaacgggagtcccaagagggtagaaaccgtaggtgtctacccttttggtttccccggcgaaaccgccgcagttctttcgcttcgcaagcgaccatccccccgttaagggaaaaagaaaggaagtgcttccatgaatcagcaccaattcttcacaggcgaaattttcgacgcctaccactggtttggcgctcacatagagcaaaacgctgtcgttttccgtacctttgcgcccaatgccagccgcattacgctgaccggcgcgtgcaacggctggaccgagaccgatctggtacaggacggccgcagcggcttctggtcggtctctgtgccggacgcccgcgcaggccagttttacaaataccgcatctacggcccggacggctctgtcaccgagcactgcgatccctacggctttgcaatggaactgcggcctgcctgctgctcgatcatcaccgacctcgaggagtaccgcttcacagacgaagcgtggatgaacagccgcacggcttcgccggacgcaccgcttaatatctacgagatgcacctcggctcgtggatgcgcaatccggacgacgcgaacggctggtacacctacgatgaaatcgcccgccgcttgattccctatctgcaggaaaacggctacacgcatgtggagtttctgccactgtccgagcacccgtttgacggctcctggggctaccagaacaccggattttttgctccgacctcgcgctacggcacgccggcacagctgaaaattctgattgacaagctgcatcatgccggtatcggtgcaatcatggattttgtaccggtacactttgccgtagactcctacggtctggcgaaatacgacggcacgcacctgtacgagtacccgcacagcgcggtcggcgaaagtgaatggggcagctacaatttcattcattccagacgagaagtacgctgttttctgcagtctgcggccgattactggctcactgagtttcattttgacggtctgcgcatggatgcggtctcgcgcctgatctactggcagggcgatcccgcgcgcggcgtcaacggcgacacgctcgaattcctcaaaaatatgaaccgcggtctgaaagcccgccatccctctgctctgctcatcgctgaggactcgactgcctatcccggtgtcacccgtccggtggacgagggcggcttgggcttcgactacaagtgggatctcggctggatgcacgacacgctcgaattctgccagacccagccggatctgcgtccgcgcgaccatgacaagctgctctggtcgatgcactatttttccaacgagcactacctgctgccgctctcgcacgacgaggttgtgcacggcaaggcggcaatcgtgcagaaaatgtggggcgcggacgaatgcgacaagtatgcgcaggcgcgtgtgatgtatctgtatatgttcacgcatccgggtaaaaagctgaatttcatgggcaacgagctgggtcagctgtacgaatggagcgaagccggtacactggactgggcactggcagaacgtccgttccaccgttttttccacagcctgtgcaaaacttatgtggagaatcccgcgctgcacgcagattatgcgccggataatttccggtgggcggaaaatcatgcggatgcgccctgcgtattcggcatggagcgccgtgcaaacggagaaacgctgctcgccctgtgcaattttgcggacagcgaacagaaattcaccgcttccctgccgaagtttacgattctgcttgacagcaatgccgcggagttcggcggcaccggagagacgcttgccgtctcccgcaaggatagtctgtgtacggttgcgctgccgcgatacagtgcggttctgctcaagctgtaaaatcgaaaagcagccgaaaaggatttcttttccgctgccgtatacaattaccaactgctaatttctcattgcgaatcaaaaagcgctctgctaaaaacagagcgcttttcctatttattcgaccgaaatcggctttaccatctgataatgcagtccgttctcatcgcggtactcgccgcgctgcagaaaaccgaatttatgataaaaaccctgtgcacgcatgtttttctcggcaacacgagcacacagctcgcgcttgccgagcgcacggtacacgctgatggcctgaccgagaatctgtccgctcagaccgcagccgcgatagtcaccggcaatgcagaagccgccgaccagaccgatctccggctgctcctcccaccaggttttcaggtaaacgagcgcgacctcttccccgctttccaagcagccgaaggtgcacgcccgcggcgaaaccttctgtgcccgctctacatcgcggatgagcgcatccggatcgaggtttgcatccgtgccgtaggcattcttgtgcagctcgcgcatgaatcccacaattttatccacatcctgtggattctttgggtcagcgcggcggaaccagatctgcggcgacgccggaatgcccttggtattcgtccagccaatggacgcaaacgtggagtattcctgcggcaaatgcgaggcatcattctcgtaaaccacgtcaatattgccgttttcgtcaaattccagcttggcaacacaggtgttgtcaccccagccgatttcgcccatctgttcgggtgcaaagccgtgtgcaatcgtcagcatgccgcgaatcgcactgccgtgcgtcactactgcgacctctttgccctcattttcgcgcacaatcgcgcgcacgccgtccagcatgcgctgaccggcctgcatgaccgtctcgccgtgcggcggcgctgcttcccacggacgggcacaccacagcgcgtactgctcaggccatgtgtgcggcagctcggcccacggaatgtcctcccagtctcccatatcaatctcgcgcagcaccggtcgggtctccaccgagagatgatgcggctctgccacagcctgtgccgttacacgtgcgcggaacaggtcggacgagtaaaccgccgcaagcggcacattctcaaaccgctttgccagatacggcagctgcttgtatgcccgcgtggtcagcagcgcgttgtactgcccgtgacaccggcggtatacattgccctctgcctcagcgtgacggatgatgtagaccgtggttctcatcagcctacctcaaccgcaccggacagctcggtgacagacttcacgccgtgtgcatccagccactcgttcagctcggcaagcgccttaaccggagcggtcgggtcgttgaacatcaccgtacccatggcaaccgcgtctgcgcccgcaagcatcatttcgacaatatcacggccggttcggatgccgcccatgccgagaatcggcacggaaaccgccttacgcacctgatataccatgcgaaccgcaaccgggaacaccgccggaccggacagaccgcccattacgttggacaggatcggcttgcgcttttcgatatcaatgcgcatacccagcagcgtgttgatgagtgacagtgcatccgcgcccgcagactcggcggcacgcgcgatctccgcaatatcggtgacattcggggacagcttgacgatcagcggcttcttcgccttggccttggctgccgaaacaacctcctcgaccatcttcggctgagtgccgaatgccatgccgccgcattttacgttcgggcaggagatgttcatctcgatgaggtcaacatccgcatccgaaatcttctcgaccatgccctcatactcctcgaccgtgttgccggagacgttggcgataattttggtatcataccggcgcaggaacggaatctgctcctcgatgaaacgatcaatgcctgggttctgcagaccgacacagttgagaataccctgcggggtctccgcgatgcgcggcgccggattgccgagacgctcggtcggtgtcagacctttcacgccgatgccgccaagctgggacaggtcaaaaaattcgccgtactcatggccgaaaccaaaggtgccggatgcggtcgtgatcgggtttttcagctcaacaccgcaaaagttcactcttaaatctgccattaccactcgacctcctcagcattgaacaccggaccgtccttgcagacatgaccgtaacgggtttcgccgttttccgacttgagcgcgcacgcgcacaccagacaggcaccgatgccgcagcccatgcgctcctccatcgaaacctgacagggcacgccggcttcctttgcaatcgccgcaatcgccttcagcataggcttcggaccgcaggcagccacgccggtcgcacctgccacctgctccttcagcacatcggtgacaaagccgtgacgcgcgtaggtgccgtcgtcagtggtgacaaaggtctcgcattcatcacggaagtcgccctcaaggatcaccgcacccttgttgcggaaaccgaggattgcggcaggctgtgcacccttttctactgccgtgcgaacacatccaagcatcggcggtacgccaatgccgccgccgataaagatcggacggtcgcccagtgcctgcacatcaaagccgtgtccgagcggtccgagcacgtcgagcacatcgccgaccttgcgttcgctcagccatttcgtaccatcacccttcacctgaaaaacaatgcgcagatggcttccctgccaggtgcagatcgaaatcgggcggcgcagcagatgaccctcaccgcatgcaatgtggacgaactggccgcactgcgccagtttaacgatttccggcgcgtccagcaccatcagatacagaccctcgcccagccgtgtattttctacaacacggcagttttcctgaatcgacataacatttctccctccgttgatcggtctgccgacgaaacagtggatttttcgacagcaggcgaaaaaattcttcgatagttctattgtacaggaaaatcggaaaaaagaaaagattctcctgcattttatgcaaaagaaaaagcagcaactttcgttgctgcttagatgtaggcgttgagttatcttcccgggccgtcgccagccaagtattgtcaccgtaaacgagcttaactactgtgttcggaatgggaacaggtgtaccctcgtcaccattaacacctactatttcgttgcacattcctgtgcagctttgttattatatcataccatcagcctgctgtcaacatctttcttgaagaaatttggtgacccgtgggagaatcgaactcccgtttgcggcgtgagaggccgccgtcttagccgcttgaccaacgggccataacagttagacttccggtatctcggtttcgctgtggactctctcgaacccacagcgcaccgaatctggtacaccatcacgggctcgaaccgtggacccactgattaagagtcagttgctctaccaactgagctaatggtgcatactttcttgtgtacaagaaagtatgcaaagaaaactttacctgcacacttcgtgtgctttactttctcattcacaatctgaaagtgtaatttatttctttacaccctcaaaactgaacaatcctactcgcaagctatctttcgaggttacctaacatttaaggtcaagccctcggcctattagtatcagtccgctccatacattactgcacttccactcctgacctatcaaccttgtagtctacaaggggccttactcccgaaggatgggaacacttatctcgaggggagtttcacgcttagatgccttcagcgtttatctcgtccgtacttagctacccagctatgcccttggcagaacaactggtgcaccagcggtacgtccatcccggtcctctcgtactaaggacagctcctctcaatattcctgcgcccgcaacagatagggaccgaactgtctcacgacgttctgaacccagctcgcgtaccgctttaattggcgaacagccaaacccttgggaccgaattcagccccaggatgcgatgagccgacatcgaggtgccaaacctccccgtcgatgtggactcttgggggagatcagcctgttatccccagggtagcttttatccgttgagcgacggcatttccattcacataccgccggatcactaactccaactttcgttactgctcgaaccgtcattctcgcagttaggctcgtttatgcgtttacactcagtgcacgatttccatccgtgctgaacgaacctttgagcgcctccgttactcttttggaggcgaccgccccagtcaaactgcccacctgacagtgtcccccgaccagattcatggtcgcaggttagaatcccaatatcccaagagtggtatcccaaggttggctccataaacgctggcgcgcttacttcctagcctcccacctatcctgtacatggaataccgagatccaatatcaagctacagtgaagctccatggggtctttccgtctagttgcgggaaaccggcatcttcaccggtactacaatttcgccgggcgggctgttgagacagtgcccaaatcgttacgccattcgtgcgggtcagaacttacctgacaaggaatttcgctaccttaggaccgttatagttacggccgccgtttactggggcttaagttcgcaccttcgcttgcgctaagcactccccttaaccttccagcaccgggcaggcgtcaccccctatacgtcatctttcgatttagcagagagctgtgtttttgctaaacagtcgcttgggccttttcactgcggcctgctctcgcaggcgccccttatcccgaagttacggggccaatttgccgagttccttaacaacccttctcccgttggccttagaatactcatcccatctacctgtgtcggtttgcggtacgggcaccttagtatacactagagcttttctcgtctctctcgccagttacttccctactatatttcggtcccttacgcccggggcaaccatcgcccgggataaccttaaagaaagcgtccctctagcttaaatgttcggtggttacggaatttctaccgtatgtgcatcgcctacgcctttcggcctgagcttagctcccgactaaccttgggcggacgaaccttccccaagaaaccttagattttcggccattatgattctcacataattctcgctacttattccggcattctcactcgtatgcagtccaccagtgcttccgctctgacttcgccccgcatacgacgctcccctacccaatgcattactgcaatgcctaagcttcggttgaacacttagccccgttacattttctgcgcaaaaccactcgaccagtgagctattacgcactctttgaatgagtggctgcttctaagccaacatcctggttgtcttcgcagtttcacatcattttccacttagtgttcatttgggaccttagctgtagatctgggctgtttcccttttgactatgagacttatctcacacagtctgactgctattcatcaattatccggcattcagagtttgataggctttggtaacctcgcggcccctagaccattcagtgctttacctccggtaatctaaaataacgctagccctaaagctatttcggggagaaccagctatctccgagttcgattggaatttctccgctatccacaagtcatccccggctttttcaacagacgtgggtgcggccctccacggtgtcttaccaccgcttcagcctgctcatggataggtcacccggtttcgggtctaatacctgcaacttcatacgccctattcagactcgctctcgctgcggctccggaactccagttccttaacctcgctgcaaatattaactcgccggaccgttctacaaaaagtacccgatcacactttaacgtgctctcggtgcttgtaggcacaaggtttcaggttctttttcactcccctcccggggtacttttcacctttccctcacggtactgctccactatcggtcactgagtagtatttaggcttggaggatggtccccccatcttcccagcgggtttcacgtgtccgctggtactctggatactgctagcactcaatccttttcacttacggggctatcaccctatattgctgctcttcccaaagcattcagttaaagattaaagttacatattgcagtcctaaccccggaaatattgctacttccggtttggcctcttccgcgttcgctcgccactactagcggaatctcggttgatttctcttcctcgccctacttagatgtttcagttcaggcggttccccaccatgacctatgtattcagtcatggttgatggagtattgctccatcgggtttccccattcggaaatccacggatcaaagcccatttgcggctccccgtagcttatcgcagcttgtcgcgtccttcgtcggctctcagtgccaaggcattccccttgcgccctttacagcttgaccagctgtaaaatccatattacatggattgtagcggataaactttcgtttatctcaattattagagtaatctcggttaaatttagctattttgtagtacaatctttcgattgtatcccaacaatatattatcagaaaaaccttttatgctgatcttgattttattcaaaatcggaataacaaatttttatcctctataatgttgcttttgctttcgtattgttcagttttcaaggtgcaaaattgctacgcaattttgccaacaaaactacgttttgtttgtgcaaatagcgcggctcataagaacttccgaccttttatagcttatgcaaaattttatttcataaaattttgtaagcatggtcatttgctcttattggtgggcttgagaggactcgaacctccgacctcacgcttatcaggcgtgcgctctaaccacctgagctacaagcccatgttagttccggcgtccggtcgtcgtttccgtcttccgacgccctgtggtggagatgaggaggatcgaactcctgaccccctgcttgcaaggcaggtgctctcccagctgagctacacccccaaataattcagggacatcagaatcttaatcttctcttttccacatttgaaggtacacaatctttcgattgcaccctctaaattaaacaacgatctgcaagtgctcattctgattgaccataggatatgagtccttattcagaactcaggtctccttagaaaggaggtgatccagccgcaccttccgatacggctaccttgttacgacttcaccctaattaccacccctaccttcggccgcgccctccttacggttaggctacggacttcgggtattgacggctctcatggtgtgacgggcggtgtgtacaaggcccgggaacgtattcaccgcggcatgctgatccgcgattactagcaattccgacttcatgcaggcgggttgcagcctgcaatctgaactgggacagcttttagggatttgctccacctcgcggttttgcttccctctgtatgactgccattgtagtacgtgtgtagcccaggtcataaggggcatgatgatttgacgtcgtccccaccttcctccgttttgtcaacggcagtccggctagagtgatcttgcgtatcaactaaccgtaagggttgcgctcgttgcgggacttaacccaacatctcacgacacgagctgacgacaaccatgcaccacctgtcaccgatgttccgaagaaaaggctcatctctgaaccggtcatcgggatgtcaagacctggtaaggttcttcgcgttgcttcgaattaaaccacatactccactgcttgtgcgggcccccgtcaattcctttgagtttcaaccttgcggccgtactccccaggtgggatacttattgtgttaactgcggcacggaaggggtcaatacctcccacacctagtatccatcgtttacggcgtggactaccagggtatctaatcctgtttgctccccacgctttcgcgcctcagcgtcagttaatgtccagcaggccgccttcgccactggtgttcctccgtatatctacgcatttcaccgctacacacggaattccgcctgcctctccatcactcaagaccagcagttttgaaagcagtttatgggttaagcccatagatttcacttccaacttaccggcccgcctgcgcgccctttacacccagtaaatccggataacgcttgctccctacgtattaccgcggctgctggcacgtagttagccggagcttattcttcaggtaccgtcatttgtttcgtccctgattaaagatctttacaacccgaaggccttcttcaatcacgcggcgttgctgcgtcagggtttcccccattgcgcaatattccccactgctgcctcccgtaggagtctgggccgtgtctcagtcccaatgtggccgttcaacctctcagtccggctactgatcgtcgccttggtgggccgttgccccgccaactagctaatcagacgcgagctcatctaaaagcggattgctcctttggcatcaaaatcatgcggtttcgatgctttatgcggtattagcagccgtttccgactgttatccccctcttaaaggcagattgctcacgcgttactcacccgtccgccactaaactaaagattccgctcccgaaggagtttccaaaatagttccgttcgacttgcatgtgttaggcacgccgccagcgttcatcctgagccaggatcaaactctctaaaaattgtatttaaagaaccgaagttcttaaaatcgactttagagtctgacgtgtcactttgttttaactggagttgtgacttccagcgatttaccaagagtaaaaaactctcgaaatttcaggttcgcactacaaccttcgttcttttgaacaaaagtttaagcacatcgttgtttaatttacaaggtacaatctgctgttttcaaggagttttcacaacttttcgttgttcttaactgctcatcaacagcttatttagtatatcaaaaccagaagcgtttgtcaagaacttttttcaaattcttttttgaagaatcaagccgttctaaaccaaacttttcggttttgcgcttgtctctcagagacagctttaatagaatatcaaatccgacagcaaatgtcaagcacttttttcaaactattgagatttttctaaaaacgtgataagatagttgcacgatactatataaagaagtgattccataaaaatcgcggttctctatcaggatcacaaaccacctgcagtggacggttcacgcaagccaatgaagtccggcggcgcagatatcgcgtactgcctgtggacgcacggcgtggacgctgcaacaccggtttccaatcccgatctgtatacggatttagaccgggtatttcaaataccgtaccgggcattcgcgcgacgcttgcagcaggcgcggcagtcagggcgttgtacgccgtgatacatctgccgactttatcaaaacccgcgatttgcttctcagtgctgaaatttatggcaatacgctgatggcacctattatctgttcgattttaaccccaaacccaatctgaccggtgctgcacggccgcaccgcatgaatcaaaactgcctgaccatgatttccgctgccgcacagggctggtcgtatttcgacctactgcacaaaatgtcggaaagccgccggcagttataactattatatgtaaggagcagaacatgaccgcacaggacattctcaaacaatattttggctacgattcgttccgtcccggacaggacgagctggttcgcgccatcctttccggccgggatacgctcggcattatgccgaccggtgcgggaaaatccatctgttaccaagtgcctgctatgctgttccccggtctgacgctggtcatttcaccgctcatttcgctgatgaaagatcaggtcggtgcgcttgtggaagcaggcgttcctgccgcgtgcatcaacagtgcgatgagtgcggaggaattccgcgacgcgctgtacttcgccgggcgagggcaatacaagctgctgtatgttgcgccggaacgcctgaccgctccctcgtttctcgaatttgccaagcgcgtaccgatttcgatggtcacagtcgatgaagcgcactgtatctctcaatggggacaggattttcgtccaagctacctcaaaatcctcgactttctcgccgaactgcctgagcggccgctcgtttccgcgtttacggcaaccgcaacagctgaggttcgtgacgacattgtgcaggcactcggtctgcacgaacccttcatcaagaccaccggttttgaccgtccaaatctgtattttgctgtcgaacagccgacctccaagggcatgaagctgctgcagctgctgaacgagcgcaaggataaaagcggcatcgtctactgctccacccgcaaaaacgtggaggagatctgcgatctgctgctcagccgcggtctgcccgccacccgctatcacgcgggcctcgatcctgacgagcgccgcgagaatcaggacgattttctgtacgaccgcaagaccattatggtcgctaccaacgcattcggcatgggtatcgacaaatccaacgtatcgttcgttatccactataacatgccgaaaaatatggaaagctactatcaggaggccggccgtgccggtcgagacggccaacctgccgactgtattctgctgtacagcggacaggatgtgcgtatggccgagtttctgattgagcgcagccacgaagccgaggacgaaaccattgacgaggcaacccgtcagcagctcatcgcgcgcgaccgcgaacgcctcaagcagatgacgttctactgcaccacgaccgaatgcctgcggcattacattctgcgctatttcggtgaaaattcgccgttgtcgtgcggacactgcagcagctgtgacacgaatttcgaggaagtggatgcaaccatggacgcacgaaaaatcctctcgtgcgtataccggctggatgaacgcggccgtgcgttcggcaaaaccgtcgtttcggccattctgaccggcagcaagaacgaaaaaatcacgcagttccatctggatacactttccacctataatattatgccggacagcaccgccgtgtatgtccgtcggctgatcgacatgctgctcgagcgcggatacctcatcgccgacccggaccgcatgaacgtgctcgtgcttgcccgcaccggcaacgcactcatgcgcggacgcggcgaattccgcgtcaagctgcccaaggagaaaaagccgacagcagccaaacagtatgcggctcttgcggaagatgtggacgaaaagctgttcgatgcgctccgtgatgtgcgaacccgccttgcagcacgtgcaggcgtgccgccgtacgttatcttttccaacgcaacgctcgctgatatggctgcaaaacagccgtcaagcgagttcgatctgctgtccgtccgcggcgtaggcgacgcaaaggcgagacgatacggcaaggagtttctggcagcgattcagaaataccgggatgaaaacctcggaaagtagtgcaatagagcgaagggaatgtgaagtttacctttgcgtgggagcacaatgtgctcccctacggaatagcgtgcagcaatcgtttgatacggtgcgccgagatcgtaccccagggcaccttctcttgcccttcgggcaattcaccttgtgctgcgcctgcgcagagcagccggtatatgtagcagtaaggaatctgacactgcgaacaggttgagaaagatacgaaagtaaaaatcctctgccgttcccctatttcaaagcggtcgccggtctctggtctgcgccagactaagaaataaaggaaacaggattcacaagggcggaaaccttggtgtccacccttgtgcccgccgccgcaggtgcggcggacctcccagccgtccggactgcacccattccgaaatcttcagcgaatagataaaaataagtaaagccgacaggcacacccatcggctcaggaaaaaatatcagccgttctgctgatcgtttttctgattctgctggctctgattctgctgctgattctgctgaccctgctggttccggttcttgttctgcttgctcatttggctcacctcgtttcgtttgcaatgctattctgcaccgcaaacgcgaaaaatatactcacaggacttgcagaatagcgaaaaacctgttaaaattgttctgcgtgttatacagttaatattttagatgatataaaagaaagaaggacactcaccatgtcgggacattccaagtggaataacatcgcaaagcgcaagggcgcaaacgatgcaaaaaaagcaaagattttcaccaaaatcggccgtgaaatggcaatcgcaatcaaggaaggcggctccgctaatccggatttcaatgctcgcctgcgcgactgcattgcaaaggcaaaggccaacaacatgccgaacgacaacatcaagcgcacgctcgataagtactccggcgcaaatggtcaggtcgattacgaggcaaacaactatgaaggctacggcgtaggcggcgttgcagtcgttgttgagaccctgacggacaacaagaaccgcaccgttgcggacgttcgtcacctgttcgacaagtacggcgcaggtctgggcgcttccggctgcgtatcctggcagttcgataagaagggcgttatcattatggagagcgaaggtctggacgaggacgctgttatgatgcaggcgctcgacgcaggcgctgaggatttcctcgttgaggaaggcgtttttgaaatctacaccgctccggatgatttttctaccgttcgtgaggcacttgagaaggaaggctacaccttcgcacaggccgagctgcagatggttccgcagaactacatcactcttgagaaggaagaggatatggcgcagatgcgtaagctgctcgacaacctcgaggataacgacgatgtgcaggccgtttggcacaactgggagaatgaggatgattacgagggttaatgccccggtcaaaaccgcataaaaaagcaccgcataccaaagtatgcggtgctttcttcactttctcacgaacttcaccgcactcattgcagcctcggcgccatccgctacggcctttgccacctgcagcagaccgccggtgcagtcaccggccgcaaacaggccgggcacagccgtcgagccgtcggcgttcgccttgatgcgcgtgccgtccagctgcgcgcccagtttgcgggcaaaatcgccgctgcccgccgttccataggcgataaacacgccggaaacgcgcagcgattctcccgcggcaaacgccacgcgcgacaccagttcatcgccctcgatcgcgcttaccttacgcgtttccacgcgcagaccgtccggcaaatccgccggagcctcgctgccatcggtcagcagcgtaacggaccgtgccaccggcagcagcacccgcgcttcctcgagcgcatactcaccctgaccgagcacggcaacgtccttgccgcgatagaaaaacgcgtcacagatggcgcagtagctgacgccgcggccctcaaatgcggctacgccctcgattttcggcaccgcacgcggcgaaccggttgccagaatgaccgcatccgcgtcaaacacgccgtccgcagtcttaaccgtgaagccttgcgccgcatactcaataccggttacctcggtctgccgcaaaactgcacccagacgttcggcctgcttctgtccgcgctcgagcagctctgccccggaaaccggctcaataaagccgaaataattctcgatcttgtccgttttggccagcgcaccgccgtccttatacagaacggttgcctgcatgccggcgcgtaccgcgtaaatcgcagcactcagtcccgccggtccgccaccaatgataacaatgttgggcattcttttgtcctttccaaattgagaatagcgaatggaaaatgacggatacacgcaatgcgcgttattgagttaattctcaattatccattttcaattccccattattttgcggtttcctcgttaaaccactgctgatacgccttctgcagcttatcgagcagcgcaggatccttgccgccgagcggcttgccgtccagctcgcatgcaccgacgcagtgcgtgccggtggacaggatcatcacctcatctgcatttttcagctcatccacagtaaatggtgcaatgcgggtcggcacaccgagcttgtcgcacagtgtaaggaaatgcttgcgcgtaatgctcggcagaataagattatccgccggaggcgtgcagaacacgccatccttgagaatcgccagaccggaatgtgcgccttcggtcacgcggtcgccgcggtggaatacaacctcgtcacagcccgcctcaacagcctgctgcatcgccatgcagttcgggataaggttgagcgttttgatgttgcagtgcagaaaacgcgtgtcctcgaccgaaatcagcttgtacggatgatcctggcggtccagtccgcacggctcggaaaatgccatcaggctggccttgccgcccttggggaacgcgtgcatgcggtgtgccactgcacgggtagactgccagtacaacatatgcggcgcatccgaatccaactgagacaccagctcgttcagcgttcttgtcagctcgtcacgctgcatcggcggctcaatgcggagcagcttcaggctgttgtaaaagcggtccagatgatcctcaagctcgaagattttcttgttgttgaccatcgccgcatcgtaaacgccgtcgccgaagtaaaaaccgcggtcggtgataggcgcctgcacctcgtcaatacggccgatttttccattatagtatgcaatatccctcatgagaatattcctcctttgatcagaattccgggttaatctaatctcagtataacggttttcgacagggtttgcaagtaggccggaaacgaggtataataattaagccggcaggttgctgacaggcgttatccgataccgcaaccgcatgttgcttgtccgtaaaaagatcctatgatacacttacctcacggaggtgttcgattatgaatacaaaggatattttatatcatctcagaaccgaaaaagatctctcacaggacgaactggctgcaaaaatttttgtcacccgacaggcggtatcccgctgggaaaccggagtttcccatagttaaagataccacacccaatatcacaaactcacgcttaaacaatattccttagtcaaccacatacaatagcaaatacaaaaaagctggaagcagacttgattttgcttccagcttttctatattatttagttttgatgcagtcgttctattatacttgtttttgcgatctttcgatatatgattgccggaataataaccgttagcgcaatcaaaaatggatagataacaaacatagggaaaataacaaatttataagtgaaaaaccaaatgctatttgaaattgctcttacaatgataaccgataccagagaaccaaatacgattgacgcaacaactgttcccgcagcatagtataagccctcaaatgacagcattttctttagctgttttcctgtcataccaatactttgaagcatggcaagttcttttcttcgtgtaataatgctggtaagaacagagtttacaaaatttgtaattcctattaagccaatgataatgcttaacgctccccctatggtaataatcagagaggttaaatcattaaaggaattgatatacgtttgtttagagtcgtaattcatactcggctcaatgtcctcaacatagctgctcaaaaattcctccatatcagcttccataccgtcaactacattgaatgggaagctaaccaaatgaggttgctcgcaaagaggtaagaaaacatccgtcggcatatagaactttgcaaatccggtacttcttatcgtatcggtgttttcattgattagcacctttgccataaccttgcagtcaaagttattatctatactactggaaagtccgttcatttgtacatgattgaagtgaagtgtatcgccaacatgaatattagggtcatcaataatgtttccattgtcatcagcggtcagggcatacagtacatagttcccggattttaatgcttcccaatcaatcgttccctctataacatccattgagttcagtaaaaaatcatctgctccatataattgaaccaaaggatttccctcagcgtctttgttataatttgaggtaactccattctcgacagaaaatgcttcttccaaaatctttgtagtatataactcgccaccctcatcaaatgccggattttgcttaactgcttcaataaaagaagtggaaaggtcatttttgctgtcgctatttccaaacttaaaattgaagtaatccgcagtagagatgatgaaatccttgtttacaaatttctctacatatttttccacatcaaagccgcttgcaagtgtgaatacagtgttgaacaataccaaactcaaagtcatagaaataataaccaaaattgtacgtttcttgttccgaccaagatttgataatgccatgcgatgaattttggctccatgtatagactttttattagacgtctttttgccttgaaatgctgttgcgtcattttcggtatagcggattgcttcaataggcgatactgaacctgctattttggcaggcttatttacgctaataatcactgtaacaagtgcaaataaagcagctccgataaaaataattggattagcagttacttttactcctgcgtccgaagcataaactgtgccgttcattaaaaatggtactaatgctcgtccaacaaagaaaccaattagcaagccgaatggaataccgataaaggaaagtaacatagcctgtttgctgataagtttctttatttgtcgttttgttgtgcctaaagttttaagctgtccgtaggattgaatatcttgaatgacagagatttggaaaatattatatataatcaaataccctgttatcataattaaaagtatgccaacaatccccgaaatcaataaagctggattttctaaaaagttactgccttgatatgcaggactaacacgagcgatcacataattgtcatctgatggacttccgcccatagtatcacaagtatagcccgtttcagcaagaagctgatgtaattttgattcgatagctccgtttccatgaaacataacataagcggcgactacgccggaatagtcattatcttcgggataggtgtatgttaaaagttcagaattattgtcaacaaaggctttagaaacaataagtcgtccgatattacttaggctgtctgtttcccaaaatccgcatagtacaaaattctttgaatatgaaatccctttaatttgatagtccaaagttacggttgctccgatttcagcaggaataccaagtgcgtccagcgttttggtatcagccataatttcattctctgcttcaggacggtgtcccgttgttggctcataccgtgcaaacttcaaagcagtatcgtccataaaccacatatcagcacgccatttttccagtccgggattattgatatgataagacactgcctttgtataggcaatctgttcaatcatctcattgccttttatattatcaaaaacctcatcgcttatataattcaaaaccgcttgaccgtcgccaccttgttttctgatattttggtcgtgaacggtatctatcaaaccagagcctaatgtaaaaatggttgtaaagagtatagtagttagagcgattgcaataattgcaatgatatttctactctttcctgctttgaaataacggttggataattttttgataacagggcgattgctatttccaaataaaatatcattcatagtttttgccccccttattctgcaattttcccgtcctcaatgcggacaatacggtctgcaagctgggcgatctcgctattgtgggtaatcatcacaatcgtttgatgaaatttctggcttgttactttcaacagtcccaatacatcgctgcttgttttactgtcaagattgcccgttggttcatcggctaatataatggcaggctttgagacaagggcgcgagcaatcgctacacgctgttgctgaccgccggataagttgttcggcatattttgcagcttatcgccgagtgccagcatttgcacaacttcgtccatgaaatttttatctactgtatcgccatccaattctacgggcaaaacaatgttttcatatacattgagaacgggaacaaggttatagttctggaaaataaaaccgatattgcgtctgcggaaaatcgtaagctgttcatcgttcagccctgacaaatcttttcctttgacctttacattaccggaagtgggaacatccaagccccccatcatattgagcaatgtggattttccgctgccggaagttcccacaatggcaacaaattctccctgttcgacagtgagagttacaccatccagagcttttgtgatattcggctcggtgccatagtattttttcaagttttttgtttctaaaatgctcatagagaacaccatcctttcttgtgatggcttcattataaagggcaatcctcacagaaatgtcacagccgacataataaattgccctgaaatgtcacaatcctgtgacatttcaaaaaaaacaggttattcatggggaagaaaaacggagaatgttgagcctgttcctacttgagaagttacttgtatataaccgttctgcaagctaataatttcccttgcgagatacagcccaatgccgattccctctatatcgtggacattttcttcccgataaaagcgcctaaaaattgctccctgttggttttcgggaatacctttgccggtatcagtgatgctgactttcaggtgcatttcccagctttcaacgcaaacacggatagaaccgtactccggcgtgtacttaactgcattatccaatatgttaaatagggcttctgccgtccatttgcggtcatgggaaacaaccaatgtttccgggcagtttacttcaacttgtatgtgcttcctttcagcgttcagaaagataccacccagagccatagcaagagtatcataaatgggctgctgtttcttttcaagtgagataacacccgtttcaagccgggatgtttttatcatagcctgcattaagaaatccagtttatcaagctgtgtgccactggcaagcagaaattcccgctgtttatccgatggcacttcttgttctaataaggtggcatttaccatttttaagtttgctatcggtgtctttacctgatgagaaatatcggaaatcaattcctgtaagtcagctcgttcactggcaacgctgtttttgctttcctgcataacctcataaagacgcaccagccgatgattgattttataaaataggttttcttcttcggcaacctgtgatatatctatttttccattcatcatttcgtctaaggtgcagcaaagtatttcagaaaacaaagtcagctttcgccgtatcagtatcacaaaaacagtaacacaaagcagaaaaagcagacagaacgccatgctacaaaataccacagacagttcttttgtcaggatatatagaaccgaaaacatgaccacggataaaagtaaaatggtagttgccagtattatgcagactttatttaaggagagtttttttgaaatcatttttgcgctcctccaatccacatatagcccataccgtaaacggttttgatgtaggaatgctggttcgtttcaattttactgcggatgcggctgatcgttgtggtaagtgcgtgttcatccacataattttcatctgcatcccacagcttttcaagcaatacctgccgggtcaggacagtttgagaatttcttgtcagcacttttagtaaacgatattccaatgatgtaagggtaatcggctgtcctgcaagacacgctgataattcggaaaaattgatatacaaattcccatcatcgtagaaatctccgccggattgtgctgaaatgcggttcagtaaagcagatactttcttttggaacacgctgataggaaagggctttgttacataatcatctgcgcccaattcaaatcctttcagcatatcgctttccatatcatttgcggttagaaaaatcacggcggtatcgggacggcgttcttttacctcgcggcatatatcaaacccgttcccatccggcagattgacatccaaaacgattaaatcatagtcctgtttttcaagaaatcttatggcaacagcctttgacatagccccatccacggaatatccgacagccgacagattatagcttaatgtcttattcaaaagctggtcatcttcaacaaccagtattcgcatagtatcacatcctttttctttttatagtatcaacaaaatgtcacagaaacctcacaacgagaaaaaaatttagtattcagtcagttccacaattacattactctgctgatacagccagtccgtaaattctttcgggctggctgttcctgtttttacagccttttttctctgcaatgcttctttcttaaagtcggaaaaggcagcctgtattttttccagacggtcagccggaaagcctgcggtattttttacccggtttattttgttgcgccagttctggcattcatttttataaagcaggtcatagttattttctcttgccctctcgtcaaattcccgcttgttttgaagcgcctgtgtttttcggcacttatcgctgcacaactcataccgctggctctttgccagaaaatatttcccacagaccttgcactgccggaagcaaagcccccagtcattcagcctgttcagataataggtaatcaacgggtagagggacgcataggcagacacacattcttctgtgcgccggttgtccgggaaccagaggtcaagccgggtatcttctgacggtgcgcctttgaaataaaggctgccagcttgaaaatatttcggttttcctgtctccctgtcaaagctcatggcttcgttttggaataccccggtcagtctgctcattttatccatgaagcggtcacaggcagcgttacggtcacggggttctctggcaagcagatagctgttccaaatacggaacgccacatacattttcagagggtcattgctaagatattttccccagagaaattcgcttgccgcctgctccagctccggctgtttccatctgttggagtgtagggcttgccgcagcggagaaagcccgtataagttccaatctctgtccgtgtcgcactcaaagtttatcaaaaaagtccccagcgggcgtgtcatatcacaaagcacctctgcgttttggctcccgttcagacggaagcggatctgctgttcttccccaatcaaaatccgttctttcattttcttcctgtccagcgtcaggacaaacaaaatcctctcaaaacatggctcatgccgtataaacagattctccatccctatcccctgcctttgtttatggtaattatataatttagttatattagttacactcatggtatcgcaggagcattgttttgtcaaggatagtccgctatgatgattgcagttggtaatttcgttccacacagtatcttgacaagtgaatgaccgtccaaaagggatatgaccggcaggagaagtgacgcatccggcgcaccaatgcagggaaacatcgcaggaatggggcaggaaaacggcttttggggagaacggcaacaggaagcattttaacctatttgatttatgggaggaacagaatgaacgataaaaagagattgaacagctacgaggatttaccgctggttctggatgtggcggacattcagcggattatgggaatttcaagagcgagcgcctatgagctggtacacacacccggctttccggcgttccgcaggggcaggcttatcaaggtcagcaaaattgctttctttgaatggatggcaaaaggctccgaaaccgcaccgggaagcgacaaataagcgtgaggtatcattccctgacttgcaatactgccgcactttccaaaggggcatacagagggaaaaaaccttaaaaatgataccgagacgctacaccaaaacagcctatctgcgtacatcagataaaaacggagaaaggagcctgttatggcaagaatgagtaacaagcggcggttggaatggtctttcttcttaaatgaccgcagccgtatcacttacaacgaactgtgccggaaatgccagcatgaatgtaaacagagcttccgggcggttgtggttgactgcccgaagtatctttccaagcgttccaagaaaaaggacaagactgccggaaacggcaaaatcccttaggaactaagggcgcacttctatacatagtctaaagaccatgtatcgtgcgtcctgcggagcttacctctgccgctgataaaatcagcaatccgaggtccgcgttcgcttcgctccgacaaggtggctacaaccccttgcgccgctaaagcggctatcccctgtgtacccgccgaaaagagaaatccgctctgcggttttcccttttcatcgggttttatagaagcactgacacacagactgtctgcggatggtctttctttatcttataagcaaaggatgtgagaacatggaaaaatctttggaacagttaaagcaggaatatgaaaaaaccactgtcctgctggaacgggaaaaacggagaatgcagcgtttgaaaaaccggcaggcgtatctggaaagcggttcccggaaacagaggacgcaccggctgattacccgtggggcagccgttgagagcattgcgccacagacaaaggagctatccgaagcggaattttattccctcatggaaaacattttgaatctgccgcaggcggagcatttcatccggtctgccactgagaaccacgcccgtatttccgggcaggagaaaggcggtgactaaggatagcactttatcatttttcaatcgcacagataaagcgtagcgccggtcagagcgccattgcaagcgcagcctaccgatccggggagcgtctttacagcagctactatggagaagtcagcgattacaccaaaaagggcggcgtgattgcttcggaaatcatgctgccgccccatgcgccggaaatatatcttgaccgggcgaccctctggaatgctgtggagagctgcgagaaacatccaaaagcacagcttgcctattcctttgatattgccatgcagaatgaattgacgctggaagaaaacatggagctggcaaggaagttcgtgcaggagcagtttgtggcaaaaggcatgattgccgatcttgcttttcacaacccggagaaagaggacggcggcatccctaacccgcatttccatgtgatgacaacaatgcgccctttgaacccggatggcacatggggacaaaaacagcggcgggaatatcttcttgatgaagatggaaaccgaatccgggataaaaacggcgattatatgtttaacgctgtccatacaacagactggcatgagccggaaacgctggaacactggcgggagcagtgggcggctgccgttaatacaaaatttgaggaaaaagggctggatgtgcgtatcgaccaccgttcctatgtgcggcaggggcttgacctgatacctactgtccacgagggagctaatgtccggcagatggaagcaaagggcatccgcaccgagaaaggggaactgaaccgctggattaaagccaccaaccggcttatacaggatgtgaggaagaagatcaaagccctgtttgtctggatggcagaggtaaaagaagaactttccaaaccccagacaccgagccttgccgacctgctgatcgcttattacaaccagcgcaacgcaggggcatggagcaataaagccagaaccggaaacttaaagcagtttgccgaagccgtcaattatctgacggaaaacaagctgctcacattagaggatttgcaggagcgtctttcctctgtcagtgaagaatttgaagcattaagcggctccatgaaaaagaaatctgccaggataaaggaattgcaggaattgatacgggagggcgagaattaccagcggctaaaacctgttcatacggaattgaacaatatcaagtttaagaaacagagggagaaatttgaaacatcccacgatgcggagttacggctgttttatgccgcccgccgtattctgaaagaaaaactggacggaaaacccattgccctgaaagcatggaaacaggaatatgcacagttaaaaacagagtatgccgaactgtctccgcagcacaagccgctccgggaggaagtcatacggctgcggcaggtgcagaacgccgtagataccgcactgcgccggagagagcagccacaggaagtacagagaaagaaacacgagatggagctatgacataaccggcagctttaccgctaccggcatttttatggagggagcatttgaatgtatttgaagcggtgaaacagtctgttaccacccggcaggctgcttcattctatggaatccgggtgggaagaaacggcatggtctgctgtccattccacaatgaccgcacgcccagcatgaaagtggacagccgcttttactgcttcggctgcggggcttccggggatgtgatcgactttgccgctttgctgcatggattggggaaacgggaagctgcggtcaggcttgcggaggacttcggcgtttcctatgagaaatccggcaatgcgccaccagataggaagcgtcacaacaggtcacagccccgacaaaaatcagcggagcagaaatttcaggaaacggaacggtattgtttccgggtgctatgcgattatctgcgcctgctggagcattggaaaacagcatacgccccacagccgcaggatgacatctggcatcctctttttgtggaagcgttgcagaggataagctacacagaataccttttggatattttgttatacggagaaatagaagaaaaagcggcattgatcgccgcacagggaaaggaggtgctgcggcttgaacagcgaatttcagagcttgccgccggaaacgcaggaagcggtcaaaaggacgatggacacaatggaaccggcacagacaccggcagaaatccgggagacgttagaggggactcagaagggcggtgtgaagaacagcatccgaaactgcctgacggtgttccagcgtgacccgctgtttcgtggggcgctgcgcctgaaccttttgacggagcagattgacattgtgaagccgctgggctgggagcgcaccagtaccacgctgaccgacatggacatgaactacctgcttttgtatctggaagaaaactacgggcttaccagcgagaaaaaggtgcagagcgccatcaagattgttgccaatgaaaaccgctaccatccggtcagggattacctgaacagcctgcaatgggacggcacagagcgcatccgttacgccctgcatcactttctgggagccgatacggacgaatacacttatgaagccttgaaactgttcctgatgggagccatccggcgggtattcagaccggggagcaagtttgaggtcatgctctgtctggttggtggtcagggagctgggaaatctacctttttccggctgctggcaggcagggacgaatggttttcagacgatttgaagaagctggacgatgaaaatgtgtaccgcaagctgcaagggcattggattatcgagatgtcggagatgatcgccacagccaacgccaagagtattgaggaaatcaagtcattcttaagccgccagaaagaaacctacaaagtgccgtatgagacacacccggcagaccggctgcggcaatgtgtattcggagggacgaccaaccggcaggactttttacctcgtgaccgtaccggcaaccggcgctttctccccgtgacggtgtacccggaacgggcggaggttcacatactggatgatgaagcggcggcgagggcgtatatcgaacagatgtgggcggaagccatgacggtttaccgcagtgggaagtataagctatcattcagtatggaaatgaaccgatacctgaacgcccaccagcaggacttcatgcaggaagacacacaggctggcatgatctacgcctatttggaggactacaccggcgacagggtatgctccaagcagctttatgaggaagcgctggggaacttaaattccccggcagactgggagacacgggcaatctgcgagattatgaataccggcattgcgggcggcatcatacagggctgggtagcctacaaaagcccgaagcggtataagaaatacggttctcaaaaaggctgggagcgtgtcaaccaagctccgccggagggggacggttttcaggaaatcacggaagaagaagcccggcaaatggaacttccattctgaaaagccaccggttgacagtttggttgacgctttggttgacagccggttgacggggaaaagcctgatatttggggcatttctctcctttgtcaaccatgtcaaccaagaaatcaaagaaaaagtaaaaagtaataatagagcgcctatggattgttttcaaagtcttttctgccggttgacacggtttggttgacacggagacagtctgcggctgtacacctgcctgacattcccttgtcgggcatatttcatttatggaggtaactgcctatggcaaaaagcaaaaacgagagcaataacaaaaacagcggcaccctgcttaccgaaaaagacggcacccagtattttgtcatggggaaagtccgtatcaaggtatcggagcatttcgcacaggatgggaagccgcttgacagcctgctggaagatgtgatccagcacgctgccgccgcttcctgaaaaaatacggaataacgactgtcaatcagcccacgcttatgatatacttgtaccagcgagtattgtataagcgtgggttgtttcttttagaaggaggatttttaaccgtgaaacaaccatacaatacaacgatttataacactgcactatatttgagattgagccgtgacgatgaattacagggggaaagcggcagtatccagacccagcgcatgatgcttagacagtatgccgcagagcatgggctgaccgttgtagacgagtacattgacgacggatggagcgggacaaatttcgagcgtccaagtttccaaaggatgattgatgacatcgaggacgggaaaatcaactgcgttgtcacaaaggacttatcccgtctgggaagaaactatatcctgaccggtcagtacacggaaatctatttccccagcaagggagtacgctacattgccatcaatgacaatgtggacaccatcaacggagaaagcgagcttgccccgttcttaaacatcctgaatgaaatgcacgcccgacagaccagcaaaaaggtcaaggctgccatgcacacaagatttgccaatggcgcacactatggagcctatgcaccgctgggctatgtaaaagacccggacaaaaaaggtcatcttctgatcgacccggaaacacgctggattgtagagaagatttttgaccttgccgtacacgggcgtggtgccgccagcattacacggattctggtggaggaaaaagtacctacccccggctggctgaactatgaaagatacgggactttcgctaatatctacgccggtgcgcccgcagaaaaagcctatgcgtggacgattgcacaggtcaagagcattttgaaagaggaaacctacatcggtcacagcgttcacaacaagcagagcaacatttcattcaagaacaagaaaaaggtgcggaagccgcaggaagaatggtatcgtgtggaaaatacccacgaagccattatttccgaagaagtgttccaaaaagttcaggagctgattgcaagcagacgcagacgacagaagaatggcacaacgcagatattttccgggctggtaaaatgtgcggactgcggatggtcattggcttatggtgtaaacagccagaacaaaaatccctatgcacactaccattgcagtaagtacggacagggattacgccagtgttccatgcactatatccgctatgatgtactgtatgcctatgtgcttgcaagactgcaatactggtctatgatggtacagaaagacgaggacaagctgctgaaacggctgctcaatgccagcgacagggaaagaaactctgcgaagaaaaagcaggctgcggagctgaaaaaggcagagaagcgtaaagccgaggttgacgggctgtttgctaaaatgtatgaggactggtctgccggacgcataaccgagtataacttcaatatgctgtccgagaagtaccagaacgagcaaaaggagcttgaaacaaaaataagacagcttcacgaaacgatggaagccgccgtacagaccgcagcggatgctgaaaagtggattgccctgatgaaacagtatgtcaaccctgtggagctgaccgccgaacttctgaacactctaattgaaaaaataaccgttcacgaagctgtcaagggcgaggacggaagccgtgagcaggaagtagaaatctactaccgcttcatcggcaaaatcgactgacctttcttttttacccaacaatatctttaattaagggaaacgggtgaaaccacaccgaatgtcgaaacgctcaagctgctttccgcgttctttaacgtgtcgatcaatacgcttcttggctctccgcggcagctgatctgccaatgctgcggcatgccgcttgaagattccatcaccagtaaagagccggacggctcctttaacgaggactactgcatgtggtgctatgccgacggaaccttcaaatacaccacgaaagagcagctgattgacttttgcgtaacgcatatggcaaccgaaagctggcctgcagagcaggttcgcgcccatatggaagccattgtgccgaccctcaagcactggaagaaataaaggagaacgctatgccgtttgacttcaaaaaagagtatagagaactctacatgccgaaaagcaagccgcagcttgtcgaagtgccaccaatgaactacattgccgtgcgcggcactggcgacccgaacgaggacggcggtgcatatcagcaggccatcagcgtactgtatgccgtggcctacacgctgaaaatgagctataagaccgattataaaatcgcaggcttctttgaatatgttgttccgccgctggaaggtttctggcggcaggataatgtggacggtgtaaattattcggataaatccggtttccactggatttccgtcattcgtctgccggattttgtgaccaagacggattttgactgggcggtacagacggctgcaaaaaagaaacagctggattgctcctcagccgagtttttgacgattgaggaaggtctgtgcgtgcagatcatgcacgttggctcctatgatgacgagcctgtgtctgttgcggtgatggacgagtatctcgcacagaacggctatgcaaacgatctcaccgccgaacggctgcaccacgagatttatctctccgacccgcgcaaaaccgcgccggagaaacgcaaaaccgtccttcgccacccgatcaaaaaggcgtgaaataacacgaatacttttcagaaaggtttgattttttgtccggaacacttcttcatatctgctgtgcgccctgctccattgcgtgtatcgacacgctgcggcaggagggtatcgagccggtaggtttttggtacaatcccaacattcatccgatgaaagagtacaaaatgcgcaagaatacgctcgttgagtatgcaaaaagcattgatctcaagctggaaattgagaacgagtacggcctgcgcaagttcatcgaagctgtttatcccaactgggacaaccgctgtgcgacctgctatgcgctccgcttcgaggaaaccgcgcgctacgccgccgagcatggctacgaccgttttacctctaccctgtttgtcagcccgtaccaaaatcacgagctgatgcgtcagatctgcgaacaaatggccgaaaaatacggtgtcgagtatctgcaccgcgacttttctccgcgcttccgcgagggacaggataaggcgcgtgagcttggcctgtacatgcagaattactgcggctgtgttttctccgaggaggaccgctatcgcaagcgcaaaaagaagaaaaagccggacgacgcgcaggcgtaagacggaaatcggggtgtttcggcacaatccgaccgaaataccccgcaataactgctttacaaacgcgcgaaagactggtatactatatcatgtactcgcgcccgtagctcagctggatagagcgttggactccgactccaaaggccatgcgttcgaatcgcaccgggcgtaccactgataaccgtctgttccgttggaatgggcggttttttgttacggtttggggggcagctttcatggagtaaaatcgaggctactgcgcaggctactatgtggtagccggaacgataaaaaagagcggcaatgcctcgcctcttgtcatggggttcacctccttcaaaatcgtttatatcttcattatatctgacgtttcggcaaaagctcaggggaaaacgcagatcgcggcaaaaagtttgtcccagggggcatttcagttccatatccttctgccgtggcggggacaggaactcctccacgttccggcgcacggcggcgtagtcctgctcctcccgccgcgccttctgacgctcggcggtcagcgccgccctccgttcttcataagggtctgggatggtctcgcctgtcggctcggtcagcgcttcaaagcgtttcacgctttgaggtctccaccggagacccgcgccccagcaagcaattttgactgttcgggcaagggacctgaacagcgcaaaatccgcaagcgagtactcgcttgctgtgcttgctgactacttcgtacccccgtatttccccctctacccatactacaatccgaatagggcgttttggccagatttcggaggattttttcaaaaaaaacgctcctatccgtaacttttctctgaacacttcgccggatgccttgtgtttcttcggatattcgtatataatgtatcgtgttgagtattatccatgcggaggtgcggtatgaacgggatcaagggctatatctccgttcgggaggcgtcctgccgttggggcgtatcagggcgtcggggcaaccagcattgcgccgagggatggatctccggcgtgtcccagttcgggcgctcatgggcgatcccggaggacgcagaaaaaacttctgacccgcgcttcaagggacggcacctcgagcctgtaatgcaattgcccgcacaaaatgaaagggagaattttcggttgattcacattttatgagcgagttattacggttgaatcacatttttaaggttttgctgccgtgcggcagaggatgtgcagcagcggttgatttggtgtcagccgcgtgctataatgacagtaaataaaaccctttgagggacagtaactcgtctgcgtatttacttgggtctgtacaatagtggcaataacacgagcccctgtgggggacagcaacctgaaggtcaggttcagcaccttgaagttgaaggcttcgtaacaactcgtgcccctgtggggggacagcaattcgtacaccgttccgtctttcttaaacttcatcgtaacaacttgtgcccctgcgggggacagcaaacaaaaaaagcatgcgtaaagcatgcttttttgctttctatcacacttttcgataccagccgttcgcctgttcgatcagccccatctgctcgagctgcccaagccgctgcttggtatagcgcgggttcagatgaatcttcaccgagatctgccgcaggctatgcggctgctcgagcaacacgagcatcgtatcataccgcctgattctgcgcgccgtatgcgcccttgcgcgctggatatgatacagccgccggcgttcctcgacactaagctggtcggcggtgcgcagcgcctttcccggacgcgcgagaatggcaatactgcaatcgtcctgcgtgcgcggacagaccacggaagcgaacgtatcggcaagctgctgctgcatcacatcggcgcggatgagacacgcgcgctgtatcacatcggtcaggatatccgcgagcgcgcggctcggcttgtgatacaggctgtgctcggttccgtcgctcatcagcacgaatgcggctttgtcccgcagttcgcccttgaacagccgcatagtctcggcggccttgtccgaggtgacaaaggtggtctcattcgcaaactcgccgttgtccggcacggacgctactttgagcgtatcgccatccagatacccgatcacgccgtcaccgatatgcactagcaggaaccgttcctcactcacagctgccagcagcagcgtgcaggcgagatcgtgcatttcgcagctatgcttttcggcttcttcggcgagttcatgccgcaggactgagagtatctcctgccggacggcctcggcatcctcacattcctgatactgagcaaaccggtccgcgaccagttcagcggcggctcggaccactcgttccgcgccgaaatgcgacagccgagccgaaccggcgccgtccgacagtgcaatgacatgcacgttgtttttgttcagccggaaggttttatcctgacagggtacgccgcttttcttgtgtccgctgccctgcatggcacagcataccaatctccacatgtgatcgctcctttctgttacagctcggcccagcccttgatgccttcaaagtcgagggaaatgctctcaccggcgatggattgggatgtggtggaaacactctggctgagccactcgaagaactcgcggaatttcagtcctttcagattgagcggcgaacgcatcggcgaaaactcggcaagcgccttcatatcggcatgcgcgccgatgccgattggaaacacggacagctttttgtctcttgcaaggctgtccatacgctgtttggcgcgtgccagatggtcggcagcaccgttcggtgcaccgtcgctcatcagcacgaaccatggctgaaagtagtccacgccgacactgcggaactgctccttgcggcgttcgagcagatcaagccccaggttgatagcctcgcccatgggcgtcatgccgccggccgagagcgtcggcacctccggctgctggtcgaggccggagaaatcccgcaggcagaccggctccgtgccgccgaaggtgataacgcagatatcagcggcgtacagcgcggtctcgtcctccttgatggcctgatagaactggtgaacaccttcgttcagttcctgaatgggcaggccgtccatcgagccgctgacatccagacacaggcacaccggaacgcgggcagacgggttgctgaccaggtttttgcaatcaaacagatatttttcggtagtatacatagaaaacactcctttagcggattgggtttaggttagggaacaggttacatgcggaaccacttctccagcgcggagagaaaggaggagcggtcggatttgatcggctcatcggtctgcggcttctcttcacgcggcatctgatagggaatatcgctgaaaatagagccgcttcggcgtgtccggcagaccttgcagcggcgcggcagctgaaaatccttcttgtcgtaggattccttttcgccgtaggtgatggagaacggctttccgcagtccgcgcagagcagtgtcgtgtagacggcgttcttcttgtgatagcagtccgggcacacggtccgtctcggcgcttttttgatgtacttgtggtagtttttgtacaccatcgcctgcccgcactcggcacagtgataggtctcgcccttgttcagacagtcaccgcagatgccctccatcgccttgtcagccggcacttcattgccgcagatgcggcacttgatatacgcaacgtgcgggttctttttcagccgggtcgggaacagctccatcgacatgctgtcgtgctcgcacagcttgccgctctgcagcaggtcgaggtaatactcgaacttgcgcagccacacatccgtgctgaaacgggtctgctcggtgctgtgcagaccgcccttgcggaaggtctcatagaagtcgttcttgaggtagcgcggcaggtggctccagcagaagcgccacatcccttcgggagccttgccggagcagcgttcgccggaggcgtaggcgaaatcaccgtttaagatgttctcaacctggttttcgccgccctgcagggagtacggcggcttgccgggcagcatgatcatgaacagcagcgttgcaacagcgaaacgctcgttgccgatggtgcgcaggaaggtcgagaagtccttgcgctggatctccggtgcggtgaagttgatggtgccgaccggacacggaaagccttcgatctggtagctgtcggtatcgacaaagtacacctcggtcggggagacaaccaaaatattgttcgggttgatatcgccgaggataacgttgcggtcgtgcaggtacttcagttttttcaggatggtgatgcacagcgtcaccgtgtcctgcttagtccagttcgggaaatactttttgagcagctgcggctgaaacacgcacctttgcagctcgcgtccgtgcgcctgccgcatcagatagccgacaaagttgtattctttgtcgtacagcagcgccagcggaaagcaaacgccgtcgcagctgaggttcttgcgcgccagcaggcataacttttcgtgccgggtgcggttcagcttttcctttttgtagatcttggcgaccatgccgggaatgttggtctggtagatcgtaccttcaccgccggaggtgatcttgcggcacagctgaatgctcttgcggttgctgtcgtacagcgcggtaacagtcgcaccttcggatggaacggacgaaaccgtccagttgcaggcgcaggatttcaccttgtcggccagccggaagcagtcgtccggcggcacggcagccggacggcgaacggcggtagtctccgacttgcttaccggtgtttcacggcgtttgggtctgccgaagatgccgagacatccgttctcggtgatgcgctcaacgcggatgctgcgcacgccgtttaccgccttgctgctgcggatgttcataatatcggctgcaagattgtgatcctgcgtgatgagcagcagatcgtagcgcagacggaaccgggtaaagacggtctggaacacgttgtccgcgaacaggcggtcgttgtcatcgccgtagatggtgatgaggttggctttctgcaggcggtcaatggtgctgagcgctttgcgggctgcctgactgcggcgcgggtcgtcgtgttcgggcgctttcgcatgcttttccacctcgcggcagacctgcagcggcacgatgatctgcttgttctcgcgcaggagaaggggaatgatgttgccccagaactgatcggctttttcgctcatcaaactgcaggtgtcgatgaagatgagatacttcttaacggcctcttcgaggtgctcggcaaatttcttttctacggtatacaacatgataattctcctttcaaatcagtgtccgctcagttgcggaacggcatcgtgtaagcgcccagctgctgcaggtgagcaatgcggctgttcttatccggatggctgctggcaagtcttgcgaacaggccggtctcgcgttcgccgccgatgcggtcaagcagtgcgcagagtgcgtcaccgaatccaagatggaacgcgaactcgtccgcttcgtactcggcggaacggctcgagtgcatcacgagggtggtgccgacgccgctccacacccagctgcagaagccgacgaacaggatcatcatcgcgtggcagatcgagttcatcacgagtgcgaatacgccgtctcgtccgccgaccagcagcgccgccagatcggcaccccagtgaatgaagttgatgaacaagcggaggagcaggagaacggtggtgatgatcatgttgccgatggtgacgaacaggatgaggtcggtgtccttgtgggcgatgtggccgaactcgtgagcgagtgcagccttgatctgctccggcggcatgcgcagcagtccttcggtaatgcagatggtcttgcggccggtggcaaaggcgttggcggacttatcatcgttcatgaacagctgcacgtctgcgggaacggacgggtcaagctcgcgtgcacgctcgtgtacttcacgaaacagcggcatgatgtagttgaggtaatcggttcggcagatttttttgcagccggtctgcagacgcagcagccactcgccgaacggcgaaagcgcaaccgcaagggacagcgcataaagggcggcgccgatgagcagtccgaccggcacaggaacattgctggagtagaacacgagcgcggagcagccgctgatgatgagaacgttcaggatgaggtaaatgatcagagaaatgttggatttccgcaggattcgtttgaaaagatcaatgaaatacataataatcgctccttaaaagttgtttcttgtcagatgatgtacatagtatagcatcgggatacccatcggagatttcaaaaacaatagaaaacacagccatggaccgctgacagctgggtctatggctgtgtttcattttttcggaaaatatggtatactaaggacaataccgtacaatacagtacatcacgggggaacgacatggacgaaaacagagaagaacgcttttacgacctgttagaggccgatgaaaacgatgcggaagcgcaataccagatcggtctgtgctacttaagcggcgacggcaccgataaggatacccagaaggcggaaacgtatttccgccgtgcttccgagctagggcatgcagcggcagcggagatgctggggaagggcagtattgccgatcaatctccgaataccgaggatgtcagcctgccggaactgtgtctgcgcgccgaagagggagatgcggatgcgcagtatgcagcggcaatgcagtttttggagaataatcgctccgaagcacagcgttacctgcgtatggcggccgagcagggtcatgcgatggcgtgctaccagctggccagaaccatgctgccggatacgctcgattatggatgtgctgtacacgaggaacaaccgacttatcaggaagctgtaacgctgctcaaaaacgcggtagactgcagctgtgcaccggcagcggaactgttgacgcggtgctatctgtacggactcggcgtagcgcacgaccgcgaacaggcggaaaagaattttgaacgcgcggttcggttttccacgccagagcaggcggcggaacagatgcttcagttagcactccggtatgccgaaggagaagatattgacaaaagtctgggcaaggcgttcagctgggtgcgaaaggccgagcaggccggcatgatggacgcgcgtgcgcaatttgacgaaaggctcgcacagtacgagcagaagaagaaggaacgcgcagaacaggagcggcggcaggcagaaacgcacgccgaatggcagcgacagcaggcgcagctggccgccgagcagcggcggcaccaggaggctatcgcggcggaggaacagaaacagcaggcagctgccgaagccgagcagaggaagcgccgggaggaggagaccaaacagcggcaggaggaaattgacgctgctgcaaagaaattacatagcgaacgccaaaagcagcaaataagagatacgttctatcgttatctggatcgcatattggagattttgggtcagatcgctggcggcatctgcaaagtgctgatgtttatctttggtggtattttctccctgataggttcaaaagataaagacgaatcttcctgcggttgtatactgctgtttattgttgtagcgttaatttggtatgctggaagccagatattacatatcttttcgtaaaataaacagcctgaccttatggtcaggctgtttttctgttattacaggtcgttcaatatggtctgcatctcctgctgcagcgcggaaatcctttcttgtgcttccttgatctgcgtgttcagcagttgtttcagctggttgttacggtcaacattcgccgaatgatttttgagattccggctcttctgcaccgtctggaagatgttccacagcatggccagaagaataacaaatgcccatgcaagcatcatcatacctacattatctgcgtccgggtcctgcggaagcaatacaccccagaacatcagcgtcataaacaggaagataaattccgaaatatagcggcggatgcttccttcacgccaaaacttaaacataaatataccgctgagaatctcgcacaggctgattataaccgcgttggtgccgttgccagactggaaggatagcagcacaagccccagcatacttattgctgaaactactgcaccgatgaccaaaagggttctctgagcctttcccggcggtgtgctgatatcatgcggcatggttagccatttatgcacattttcgcgttcaaacttttgcgattgcgcgcgtgttactcgcagctcttgcagtttgttttcccattcctgcagttcctgctgaatctcatcataacgcttttggttttcggctttgtctgcctgacgctgctgttccttttcctcggcctcgcgctgcttgacggcttcggcttcctgcctctgccgctccttttcctcggcatcgcgctgctgcgctgcgcgatagttctctacatcgctgctgaactgctccatcgcatcggctgcaccggcgttttgcgcgcgcttgacgtagctgagcgccttaccgtagctttccggcacgccgttgccgaccgcgtaacgctcggccagctcgatcagcgccatcggcttgccctgctgtgcgtacagctcggcggccttgacaaaatacgcctcagcctgttccgggtcgttctgcagcgtaccgcgtgcgttcagatagcagtcggccagccgttctgccgcatgcggaataccgcagtcaagcgcatttttgaaatagcggaccgcctgtttttccttctcgaaccggtcgttctggtttgcacagttcatcgactgctgcagcaggctttcgccgagttcgtcgcacgcctgcccgttgccctggtcagccgcggctttcagatagcggtctgcttcggactgcgccatgccgtgcgccatgaagtaccgcgctgccgcgtactgcgcgtccttgtctccatcctcggctttcatgcacagttcgaggatgtcggtctccgcaggtttctccggcgtgtcatgattgccgctttcaagcagcgctttcgcctgctcgtgtccctgatttgcggctcgtgtcagccacttttcggcttcggcggtgtccttctccgtgccgtcgccgttcagataacacaggccgatctcatattgaatgccggcgtcatcggtgttttcttccatcagatcataaaaacgatcttctctgttcattggatgttcccccttgtttctgtattttcagacagtgcttttcggagtaccgccgcaagctcctcctgcagcacctttggtccttgcagctgcaccattgggccgagatacagcagccgccgaacgatctcatgcgcgtcaaaccgataccaccggaaggacagatgcaccatatcgtgcgagatctgccgcgtttcctcgaactgctggttctcgaacacgagaaaacagcgttcgatggctcccttttccggcttgacggccagccgcaccggttcgggcatgagcaggcgttccatcgcctgttcgatcttctcttccggcacatcgctcgtctgcatcggttccggttcgaggatgttctctaacttggctttgatcgtgcggtcctgctcctcggaatagaggatcagccaccaacggcggtcaaacgcgctgtattccagcttccatggcagagcggaggcggtctgcggcgttttgtcatcccgggtgcggaatcggtagcggatgttctgccgaccccgtatcgcgcggagcagcgtccgaattttctcctgctcctgcaggccgcatggcgctgcatgcggcgtataacgctgtattgcgtcaaacgaatcgctgccgccgcagaactccgacaggcggtcgtacaggttttcctcgagcagcagccgcgcctccggcatggccagcatgtacgagagccactgcttttcagtctgctgcatcggcaggcgcagttttcggtagttaaggttcagataatagcgattgtccgcgcgctggacaatttcgtaatcgagcagcggttttatgaccgaatctgcttcggtaagccctttcttcctcgccagttcaaaggcttcgcggacggaaatcgtttgaccgccttgcagccgcgcgagtagctccagcgcgagaagaaaggcgcgattatagtatttatgaaacaaattcacggcatatttctctccagattttcgagcatttgtgtcagctgggacgaaatccgactgtccagatcgtgttctccgggcagaatgcgcagccacggcgcaaaggagcgcaaaaacggcaccagttcacccggatcgttgacataagcgcagtagtattcctgcccgtcctgttcgatgatctgtccctgccgtatctcgcgttcaaactgggtgcgcataccgggagcactatcgaaatgcaattcggcacggacctcggttgtatctccgtaggtgatgcggcccgagcagccggtgtgcgtgaacgtgtcggcaaccgtctgtaccgcgtgttcccagacctcctcggagaccggtttgccctttttcaccgcatggatgctgccgagccgcaccatcgtcggcatttcaccgcgcataccgagcaaataccagcggcccagccgggtgtcgatgcgaacggccacaggcagcagcgttacggtttctgccgccggcttgacacgtccctgcacggccttttcggttttcagcctgtcccatttgacttccgcttcggcgtgctgcgcgatgatatccagcagttgatagaccagatcctcgtccaggatattggcgtttgtgttatggcgcagcaggaaaggagacggatgctcatgcgtatcgccgcgacgatagcgctcgtttgccacctgttcgcggataaaatatccggttgcgcgaggatagccgacacccgaagtaaaggtgacgaaatgctcgaactgcatcagctcatcctcggacaggatgccgagaatgtccggcgagacggcaaaccggctgccgtttttgcacagataaccggcgctcgccaggtctttcaggtggcgcagcacccagttatacagcgaactgccatcggcatcgcttttgccctctttttcgagtcggctgcacagttcgggtgcggcagccggcttctgcgccagaccgttcagcatggagagcgtcagcggcagctccttttgctcgtccatcgtgtacagcgagtagctgccggacagaccgtattttccgctttcggtatacagccgttccatccgcgggtacttacggccgccgcggacaagtgcgttctgttcatccttcgggaagatatcgtagatcagccgcaattcctgatcgtaggatttgaccttgatgatattcgctgcttcaaaatcctcgcgggagaaaaagccgtataagtagatatgactgagcaggctgcgaatgctctcgtactgccgccgtcctgtgatgtttttacccataacccatccttttttcgtttctctcagagtttgagcagattgggatccgtgtggccctcctgcttttcctgcacccgaatgacgatcaggctcatatcatccgaggtgcgggaccagaacacttcgttcatgttcttttccagcagaaagctgacctcgtcctcttccttctctttcagccagcgtgcaatggtccggcaggccggagcaggctcgccggtcgaggtctggtacaggcttttcgccgtgccgtcgctcatcatgagcagggtgctgccggcttggagcgtgcccttctgaattcgcagatgctcgaccgcatcgtcgccggtgatgaaccaggtttcgttttcgtattcgccgttttccggcggactgaatgtgcgcatttcgccattcggctctacaagaatctgcacaccgtctccgatgtgaccggagatatagcggccgtcctcagcgatggcaacaaacagcagcgtgcacgcctgatcgtaaagcgaatagggtttgttcagcatggcattggtggcttcgacccatgcaccggttgcgaccatgtgcggttcgtattcccaaaaatcttcaaagcgtacgttcagcttgcttgcaaccgcaacggttgccagctctgcaccgatgtggctgtacggacggcttccggcgccgtctgcaagtgcagccgtggtgtaatcatcaccggcgaataccgctgttttgtcctgacaggggatgttatgcagactatggtccgagccggtcacccttgctaaactgatcttgaattccatacagttcacctcttgtaaacggtctttacttcaccccattcagcggtaggatcgtacttgacttcctcgccgctgagcgatcggctggtcttttggatactgcggctcagccagccgaaaaagtccataaagcgcaggtcgttcagatactgcacctgaccgtccggcgacagtttgccgagcgacgtatactccgccttatccgcatcgccgaccgacacgcacagcacgctgaggtgcttttcgtcactttcggtcttgagcagcctggcggccttgtccagatcacgcatggactggctttcgtcgccgtctccgatcaggacgagccatggacggtaatggctgacaccgaccttgttgtaccgctcgagacgccgctgcagaatggtatgtgcggtgaacacggcgtcggcaagcggcgtttcaccgtcggcgtgcagttccggaattttgagccggtcaggcgactcaaaatcgcattctacacgggccgaggttccgccgtagctgacaatgcacagctcaaccgaatctgccgcgatcggatcgttctccagttcccggcgaaagcgttcgagaccctccatcatcttgtgcagacggccgttctgcagcatggaatacgagcagtccacgcatacgatgatcggcgtgcgcgattccggattgttggccagttccgtaaggctgatcttgctttcctccggtgtctctaccggatatttgggttttttactggaagccatagtggtttctcctttcgtgcacggcggttatcgggttcccaaatgcttggcaaggcagctggagcaccagacggattttcctttcatccgcatctcgcggatctgagccacgctgcggttgtagatgaaagcgccgcagtcgtcacagtgtttggcgctcaggcagtccgggcacagaatgtctttgttcttgcgttgaaggctcaggactttaccggcggttgtggcaaattccctgctgcattccgagcaggtaacgcggtaggtctggcggttcagattctgctggatatcccagcagaacagacagagcatgggctcacggttcgcctgacggcgttcatatacatccttgcccagattgaacggttttccgcagtcctcgcagatcagatcgaccatttcggtgccgtcctcggacacatcggaaatatccttgtacgagttcgggacaagttcatccgtgctgtgcccgagttcgatctggcggacatactcggtcatggtctcggcccactcggcagcagtcgaacgttttttgttggtgaacgtgttgtagaacggcgttttgacacggcgtgtggtgtggctccagatgtagcgcgaaaagccgacaggcgggttgagtttgctgttggcaggctggtcctcatcgtccgaacggtagggatacggaaatgtaccggcaataatagcatcgactacatcctgattgttgttgttgcggctctcgtagggagcacggccaagcgtgaggatctcaaacagcagtaccgcgagggaatactgctcatcctgaatggtgcgggtaaagccaaagtccactctgccgaggcgtttcatctctcgatggcgttccgggggcgtgtagcgcaccgtgccgaccggacagccgaaagcgccgatctggtagctgtcgcagtctacaaagctgacgctgcagtcctgcgcgaccataaagttgcgcggattgatatcgcccattaaaatatcgtggctgtgcatctgcgcaaagatggacgcaatattggcagcgatctgtgccagacttttgcgcgtccagccgcgctcgatgatgcggcgctgcccacggccgggatggaacacggtcagcgccagttcgacaccggcggcactcggcatgaggaaaccgaccgggatttcatccttcgtgtacagcatcgcgcacggccagcaaagaccgtgaatatgcggatcatgctgcaccatgtagtccagcttgttcttacgctcggtgttcattcgctttccggtgtagatcttggccgccagatgttccggcgaattggtattgaagatttggccttcaccgccttcaccgatcttggacagtaagcgaatttcggaatagtgtccgtccggccatgcagcgttgagcacggtgccggttgtgctgtgcggcgccttcggctctgcgggagccggtgcaggtgcgggtgcgggagccggtgtggattttgggtctctcatctcggagagcatcggacaggttgcaccgaataacagcagttcggcttcgtccatcggcttggacgtaacgaggttgcggcagggcagcgcggcagcggcttctgacatggacttgtccatggtcagcagccagaagcgcgtagtcgggttctggagagcggcggcacgcagattgtcactgctgtcgcggctggtggtcgggctgtacaccacacggatgagaccgtgttcgttgagtgctcgcagagccttgatcgcgttcttttcgctcttatgcagcttttccagcgcgcggcgccgttcctcgtcgaaggcttcggtgtcggacggacggctgctgcggaatttggagaacatcgtgccgataacggacgaatccagccaaagctgctttttctcctttgcgagcagcggcagcagcgttgcggagatatagcggcggccgactgcggactcgaacagcgtttcatccgctgtgagcacgaaattctgcagaacggcctgcagctgctgctccagcttgaacatacggcgctcgggacggagagccgcgctgacctcctccggcagacgcagttcatccggtttgttctcggcgaactccgaggtatcgccggtctcgtcgagcttttcgagtttttccgtggtctcacggcgctttttcgaccgtttttcggtctgctcggcaagctgcctgcgttcttcctcgctgccgcgcggacggagcaccgtataggacagcagttcttccagctttgtgcggtccggatattcgtaaatttttccgtccttttcgttgatgttgtagctttggatcacgtccctgacggcggcgatctgctccaacgtcagctcgtccgtacggaataccacgcaggccgcgtcgtcaaggtcgattggcggcgcactgaatttccggcggtactcttcttcgatgcgtttccagtacgcgcgaatttcatccgcaaacggaaaatcttctcttttgcacagcggtacggtaatgcgctccaacagctgaatatcctgctttaagctgtctgctgtgatgttttgaatgccctcgattgtgtcgtgcgagtacttgtttcgcaggtgaatcgctgttttcaagtttgaggtataattccgtttgtcacccatcaaattgaaatagcgaaagaaattgtcgctgtctatcgggtgctcgtccggttttttcttatcgaatacacgttcatgaccgtgagccagatattttaatgtacactggtaatcaatagaggaatatgggtcggacggtacttcatccggactgccgtcatacttgctttcctttaaaagattattaccatatttaccgtttactttgctttccagaaaaagtccgctccagaactccgcatcggatacaccgccgtctttattcgccgcccggcatccctcggccagaaaccggcgcacaccatcggcttcggtcaggtttttgccgaacaggttggccatgcgtttctgttcataatccagttcgatgctctgctgttgttttttcgccatcgttctccctgccaatccctttttgtgttgtttccagtttatcatatatgcagcaggataattttcaatttccatagaaatcgcacctgcctgaaatgttacaaaaaaccaattttaattatagcacatttgccttgatgcgcaagggaaccgcagccgagaaatcagcttttgtacccgtgttttctatcgtttttgaaagaacagaacggtacttttgcggtatactgcaactgccgtcaagggatggcggcagttatttactcctttcatagagacagaagattatccacaccagagtgccatagaaggaggaatttttcatggcaaaacgttttttcaaagtacggagctgtatcgcgtcggttctgtgcatcgcatcactgtccgccgtcagtgcgcaagcgttctcggatgtttcaccgaacgcttattacaaaacggcggtggattgggcggcctccgaaggcattacatcgggctcggacaaggaacacttttcgccggacaagctgtgctcgcgtgcacagacggtcacgttcctgtggcgggcaaacggctcgcctgcggtcagcgggaacaatccgttcacagatgtagcgccggaggattatttctatcaggcggtgctgtgggccgtgcagaacggcgtcacgtccggcacctcggcaactgaattttcgccgtacaagcaggtaacacgcgctcaggtcgccgcgttcctgcacagagccgccggcagtccgaatccgcaaagtatggccagatttgcggatgtgagcagcagcgcgtattacgcgaacgctgtttcctgggctgcagccagcggcataacaaccggtacgtctgcgtccgctttctcgccggataaggggtgtacccgtgccgagatagcgaccttcctgtaccgcagtaaaaacggttccacgcagacgacaaaaccggaacctgcgccggaaccgacacctcaagtgacggaaaagccggtcagcgacctgacgaagctcgacgagaagaaggaagagaccaagccggagatcgtcgaatcagacaagacggaggacacgcgggagccgcatgagacaccgtgcgtcaccgatgcggaaggtgcgtacaacgccatctatcaagcaatcgtcagctacacaacggaagtggacctgcggcagtaccatgtcgattggaataccttctacaaggtgtgcaaccaggcgatcgacgacgcctatgtgttcgacccggatggtccgtatcggcatttctccttcgacaccacgcgcaagaccaataacgaggttgctcgcttgacgatcgagtacgagtatctgaacggtgcagacgttaatatcaagcgagaacagtacaagaatctgcgcagcgcggtcaagatcatcgtaggcgaagctgtcaccgacgatatgagcgactacgacaaggcgaaggcgctgcatgattatctggtgctgaacaacgagtacgatatgcgtctgtattccggcaatatgccgcacatttcgtacaccgcgtacggcgctatcctcgagcatacctcggtctgcgccggatacgcctatgcgtataaaatgctgctcgaagaagcgggtattccggtcgaatacgtccgcaacagcaaccatgcgtgggatatcgtgcagatcgacggtgagtggtaccatgtggataccacttgggacgacccgacgcctgaccgcaagggttatgtccggtacgactacttcctgcgcagcgacagcttcatgtcccgcgatcattccgcatggacggcgtcccgcaagtgcaccagcacgaagtacgacaacacgaccgttctgaatgacgaggagaagaagcagcaggaggaacaggagcagtacaacgcgctggtcaatgaaatccttgcgcagatgcagcagcagctggcggcgatgccgtatcaggatacggattctctgcagaatgccgaaaatctgacgaacgatgacgtttcctgcaagatctatattcctgctgacaagtatgagtacggaccgatgcagaaggcgtgggaaaagctgacccagctgaatacccgtgaggatttcgtcatctgcggtacggctaaaacgcagaagaccgaggacaaccggtggtatttctcggtgttccgcaaggacattcaggcggagattcagcgccgtcaggacgagaactcgcaggcggtctccgaacagggtgagaagctcatcctcgagctgcagcgcgcgatcaagtccggtgaagcggcggactacgtctacagctgcccgaactattcggaagcggctatcaagtacgcctgcgaccgcatgaacgcggacgattacacctttgaggactatacccacatggactacatgctgttcgagatgccgaccagcgtggagatcctcaatcaccgctgggagcagaaccgcatcaaagcgtggacagaggtgtttgaacagggtatccgcaaccgcgagacccgcatcacggttgacgtgccgagcacatacgacccgggctttacgccggtttcctccgagaaggacttcatttcctggggtgcgaacaacgctttctacgaaggaaatgtcgtggacggcatggtagccggtaaggatttccgcaaggtaaagagcgggttcagcaccgacaccagcggcgaggtcaagagcttttttgtcgaggtggagtatctggacgcgcagtcgtaagacaaacaggcgataacccaataggattagttgaacgaagaaccgagggctgttccggcgtatgcaataggaatggccctcgggttctttggttgcgttggtgcaagccgcgtgatataatattatttaatagatggtttggggcaggttcgcaccgcaataaacggctgattttaccgataatagcgctgtaatatcaaattttttgcagtgattattataacaagttacagaaaaaacagctgaataactgaattacttcattattttttgtgctgttttgctgaaacatttcatacccctatggggacagcaacgaccccgacaggcctcgaatatccattgcatcacggcgaaacatttcatacccctatggggacagcaacagccgtcggcgaaactcttcgtgctcggcacgaaaaacatttcatatccctatggggacagcaacttgtggccctttgcatgagcaccaaccgctcacgaaacatttcatacccctatggggacagcaaccatcgggaaatagtccacgtcaatgtgattcctgaaacatttcatacccctatggggacagcaacacacgccatttcggataacgctacacatttcaattccgaaacatttcatacccctatggggacagcaacatatcctgcatatataccgagtatgcctcgagactgaaacatttcatacccctatggggacagcaaccacaggctttcatcacgcacccacggctccgggaaacatttcatacccctctggggacagcaacagttttcgacgctgcgcttcgcggcgcacggtgtgaaacatttcatacccctatggggacagcaacgcgtcggcataggccttgtttgtgtgtttccactgaaacatttcatacccctacggggacagcaactcatcgtcgaacagcagtgtcgccgccagtccccacgaaacatttcatacccctctggggacagcaactccgccgagagtgccgcatagctggtcacaaacacgccgaaacatttcatacccttatggggacagcaacacaaggaacaggttggagaatacctcaacgtcatggaacatttcatacccctacggggatagcaacttccaacacgtttgcgatcgtctcataagcccgtccggaaacatttcatacccctatggggacagcaacctctaatgttgcatcgtctatgtcggtcgtgccgaagaaacatttcatatccccatggggacagcaacgccttgagttcttccgaggttgcgttcgagataggaaacatttcatacccctatggggacaaaaagaaaaccgatatgtccaattggacatatcggtttttactttatccgctcttgttattcacatgttacgccgcccataccgagcgccgttttaatgccgacacccgcatacggtgcaaagtgcagcagcagattcgccatcgtaagatgaaaaccatccagacggcatttaagcgtcagctctccggtgaatccgggaatggactgtcctttgagcagataatcacggctcgacagccggtaatcggcaatgcggagtccgtttgcgatcgcctgaatgccttcgccgtcctcgtcctcgatcggacagacctccgcaaaacagccgttccacttgttcagcagatttcgcataatgagcggcacggacggcagattgacatagctgccatcgcttttgaatgcggtcggcgtgagaaaccgcagcttcattgtgcggtgctcgggcagctgcagcagcgtgtccgccgaatcaatatgctcaatctgcatcgtgctgacatgcagtgattggttttctcgacgcagccagtagcggtcctgctgctcaatgattggagccagtacagcttcgctgtccgcgccgaggagatttacatgccagatgacctgcttgtcctgcacagtgatgcagctgctgagcggcgtgatgccgtcgctgtgcatgcgctcgccaaagccgtgcggtgtcagcgacagcagcgaagaatacaggtggtagccccattccggaaaaatacgcgtctcgtgctccggcaatagggtgatttggtagtgggtgatcatatattttccctttgcatgatttctttgtatgttttccgtttattgctgtattccgatgcggcatataccgcattttcacagcggctcaagtacgttagtgaaacgcatacaggaaaacgctcccatgttatttcctcggtatctgccgcattccctgtgaatttacgcagcggctccaacggtgtttttctaatctgcgctgtggaactgcacttttgggttgtgtaatagtccagatagctctgatagagcgcattcataatatcatcttcatgcgtgaaatgcagcggcacggttttaaccactttcgtaatatcttctgcaaagaacatacgataccaacgctcaccggtaggatttgctgcacgcgagccaatacgtttacgcagattgagtatcagtgatgctaaatcagctaatctgtcctctaattcaatccggtggtcaatatctgtttgattttcatctgctattgttgtttccagcagatcatcatcaccttcgtcatctccgtttggcattaacggtgcatccagcgaagtagtattgttttttcgctcgattgcttttttgctgtctttttttcgttcgtgccaaatgcttccgaaataacgagaatacgggataccgtggtcaggatcaaaatcctgcaatgtcttataaaacaaatttagcaaatttatgctcttcttttccgtgatatcagcatagagtggatcctgtattgtatcccagtccttgcaccagtcgaaaaaacaaatccaaacttgttctttctgttgttccgtatccttgccggccttcaccgcgttcttccaaatgttgaccgcctgattcagtctttcttccagtgtttttcgggttgcctcagtcattctgctcacctcaatcctgcgagatgatcttctcgatgacagtgcgcggattcttgaccttatgctctgccaacaggcgagtaatctcatccatctgaatcagagcagtcatatcgttgacgctgggagcagcgccaccccaacccggctgaccgtatactaaacagcagatagaagcattatctaacagacgataggcatactgtatggccatgatcaaaatctgcgacagcggcttcacgccataggtcatacaagcatacagcttgtcattatcttctaccttttcaatcaggcgctgaaaagtctcaatatggctgcgcacacctgcatccgccggagcatttacaacttctatgccgcgcggataagtgaagccaatcttctggctcatcttctctacttcctcgcggaatttttcaagatttgtttcgcagttctgtacagcggacagaatcgcgacaacacgaatctcctctcccggcttggcgtaagcgtgcatagctgtcatgatcgggaaacaggtcggtgtgtccatctgcaagtcgctgttgtctacggcctgataaatgcagcctttcagatcattgccgcgctgcagcgggatgattgtaaaaaatgttttcataagactctcctcaaagcttcaaattgttcagcgcgttttccatcacagtacgcagtgtcttcaaatccacagcctccggtgaacggtagccatatcccttgagatattcgaccgcctgttccgtgctttccgtaccagtggtttgtgcatggttgatcatgttgcgcagaagtttgatatacagataatcgcgtgcaatgttttggagtttatggattgtatatttcgatttcaactcaaatggagctgatgggaaacaggtctccagattttcgatcgtgtatacctgcattgcatactgatcaccgctttccttagatgcactggtgtaccggctggcgttcagcaggtaacagaaaaactcatcggcatcggagaaccgtgttttatcatcgtatttcggattaaacaggtggttctcctgctttttctgtacaatattcttaaaaatttctgtcggaatacattcgatatacaaggttacggcctgctggtacatatcccgttccagacaccaacggatcagactgcggattttgaacttccgctcacgaaagatactgtcaaatgccggagtaagctgacggacgagtggattatcacaggattttacttcattcactgcatggataaaccgctcaagacatccacttactttgcttgttctgcacagcgtgatcgcctcgttaagcgcttcgagtgcgttgagcagttcgccgatccgttcgtcctgcggctctgcgccgaaatacttgcgcagggtgcgtacattgccgaacgaactcatttcctgcatgccgcctaccaggtcgaacatgcggagcagatcggatacatcggtgatctgctggttgttaaaatcagcataggtcgcaccgatcgtctgattgtggttatacgtcagtacgcggctgagaagcagtagatacatcatcgtgttgcgccacccgccggtcgtttccagcagaatttcatcacccatgctgtttttgcccatgccgcccggctggatctcgttcagaacacgctgcagcggaccttcggtaaacacctcgtcattctgaaaatcaataatcttaaagatatcgtccggtaattggatctgcttttctcgtgcgaactccagaatatgcgttttgaaaaaatccagcgtgcttttctttgcctgcggcgttacgatacaaatgatcgaccggacatccggatgtgccagcagcatggccttgaccggcgcttcgttggtctgcgtgccggtgatctcgtgggcctcgtccatgccaagtacaccggccgcgcaggcatagtccttggtcttccgcttggattcatcctcgctcagcaagctgaggaataaaataatttttttcgccatgctgacctcactttttcttctttttcgaggattttccggtattcgacgaatgcgtctttgcaccaaatttcaggagcagtgcagctgttgcatcctctgcagaatcatacttcggcgcatccttttcggcttcctcacgcagctcggcaaccgacggcagcggataatacatttccttaaacagcagccgcttgggttccttcttctggtcaatcgtcaggtaatccaccatttccgtatcctctcggatcgtctttttcagatagaagaagtccttgatttcgggtctatcatccatttccggtgcggttttcgatttattatcgttcataaactgcttatacgcctggatgaatggcttgcactctgcggttcttcctgcgctctcgaagccggaagccgaatagagtgctgcgaaatcgaacagccgcagcttgtccagtttgacgctcatacggccgaagccgtatggcttgcccatgccgatcgactgatagcagccatcattcagcaccagcgaccacagcagcagaccgagttcgtcttcttcaagatttttgaagcgaattgtaccgctgaacgcagttcccttcttcatcggacgcaaggtagtcaaaaccttttcattgccgctttgcggcagcgggaattctacatctttaagccaatactgcttaaaaccgtttaattggaaggcgtctttcggctcattaggctcataagaatagtgctttccttcctgcacatatccctcgaaaaagctgggttttggctcaccaagaacagttttatacgcatcagcaggcgcggcattgcttatggcttcaaaatcgccgaaggacacgcgcgaacggtaagatgtattactgctttttttgttttcgtccttaaaattatgcgtaaaccctaaaaccgcatgcggatagtccagtggaagctcattctgcgaggtaatacgcttctgcattttccgaaaacgctcgggcagaccttccgcaatggaatgcgaatgaccgatgcgcagatagcgtgccatgccgaaataaatgtgcccatcataatttacatagaaaaccggcttactctgtccctcctccggcagcttccagaactcctgatatgctttcgccgtatttttgcgcgcttcgcagtccgcctgataggacaagcggtcagcttccgaaatatcaatgccgtgttgatctctatcgatcggcggaaaaacatacaaatggttttctttctgtaccggttttccggtaaacagcaggataccgcgttccttgtgtgccggggcattttccgcttggtacagtgcggtgacatttttgccgtccgactcatatgcgactgcttctgtgcaggcatatttttctttaccgaatactttttctgtcagttcacgcgatacacgcagtaccggcgtttctttcggcagcggatagatccggtataagctgttttctcgcaccagataacccgcgttgatattgtgcggtatggaaatcgacttgccgctccgggccttttccggctttacgcccagcgtatcctgatagtatttgcgcagcggtttgcgcgcaccttttcctgcaatttcgcggtaataaatctggtaatcctccagatcctcatccttgagaaccaaaccatccccaagaatctgcatattctcccttaccatgccgcgaatggtagaaccgggaatcatatagtttccgttggcgccgcggaagaaatccgcattttcctgtccgtccgacacgaaaaccggcgtttctgcggtaagcgtcagatgaatctcaccggtgagcagttctgcacaaagtttatcatgcgcaggcagtttgcttacatcggtataccgcataaacggctgacgctcggtaaacggcacaaagttatatggtgcacgaacggtgttttccaatgttttcggcggatagtagttatcgtccttcgccattcgtcattccctccaatcgtacaggcagacggcgctcacaccggcctgaccgtcttcatcaaatgtcaggtattcgcgcacgctgacttcactgccgagattaccctgcaagcctgtatagtgctttttgatgtatggggtgtccgctctgagcgacaccttgcgggcttttaatgcgccgtcctcccggaaaatgcggatctcggtatcatgatcgaaaaaccgtgcttcgagcagttcatcccagttgatatccatcggcattttgccaataacaacacggctcagctcggtcaccatgacgaactgcagcttttgggcctgttgcagagcctgttctatgctatctatccgtttcatgtgcgttcctccagtgcatgcagccaggccgaaaccagattgtccgtgtcgttcagcttgcagccgtccacgccgaatgtcatatcggcggttttgtctccgcacgcgattgcaatgcgggataccttaatataaccgcgtccgacagcgccgccgctgcccagattatataacccaagaccgaggtcgcgcagtgcgtaaaccaacagcgcacagccgcagatatcatcctgcggtgctgtgatggtcagcgtgacgccgcttttcagcggttcttcggtgaatagtccgcggcgtatcacaccgccggtgaatttattgatgcggatacgcgagactgtctgcttttttgccttatccagcaccacatcggtgaaccgcactcgaccggcgataccgttatcaccttgtgcagcaccgcgtccgaacaattcgtccacggcttccgagcagtcgagcaagtcggcgatcgcctgcacacgggcacgcacagcacccttgaccgacgaacccggcaaaaccgccgtaccattctccttaatgttctgaataatctccttgcgcgtattattctcatcgtattcaacacgcggaaccgaactcttgatcagaatgctgtccgcaacgccgttgactgtgaatgtacatacgttttccgtgcaaatctccggcagttcaagtgtttggccgtcaaatttatcatgcagccaagcatcccggtcggccttgtcggtcatgtgataggtctggcttcggaccgtcagcgaaacccgtccgaagccgttggatttctgtgcgcccaaacggatctcacctgtgtgcagcgcaccgagcatctgctcgatctgcgccggaccgtcggtatcgctttccgcgcccatccatgtcagagtgaactgcatcacggtattgcgtgcaatgtgggccacatcgaatttgccgctgtctgccgcagaccccattttgccgttgatgcgcaggcgcggacgaagctgaatcgtggtatcctccgccgatttcgcggctttttccttgatttccatatcggaaacgatgagctgtccggacttttcctgcgaaccgaacagcgtgtttgcggcgttcttatcctgcttttccagccagccgcgcaatgcgccagccagagaagcggcctgcaagtatgcctgtccgtcccggtgacggagtacacggtcgatactgccatccgaaggaccggtacgcaagggcgtttccgtaactgccgttacctcataacgaactgctttatcaaacgttgccatggcctgcgtcctcctttcgactgtgatcgaacaggtcgcagagcagctgtacccgttccagtgttgtcatgtcctgcatccaaggttcggtcggatgctccaataccgtgatgatcagtttttcgatagacgcaaacttgctgatcgcctgtgcgcccttttccgaattatgcgcaaaataattcttcatctgctgcagagcatcgggattgtgtttgtgctcctcgcaaatggcctggatagagccaagctggctgtccgaaatatcgccggcgaatttcttttcacactgctccatgatccatgtcagacgcttacgacgcagttcagccatattctgtcggcgcggtgcagcggtgtactccaccggctgttttgccttgatgctgccgaacagcgattccgacagaaacagcacctgtccgaacccttctgcgcggcgcaggcccaatccgctctgctcaatggcggaaagatgttcctcattcggcgattcaccatcaaagctgattttgaacaggctgcccgcatcatacatgcggacggccggtgtgtggcatccccactgacggttaaagccgccgtattcggagaccgaagtgctgctgaattcggatgttacgcttgccacaccgaggttttccgcgagcacatcccagttgataccgcacggctcaccgtactcgtttgtcatgccgagcggcgacagcgccagcatataaagtatcttgttatcaccgtgacgctgcatgctgccgtatcggcggtacgccggagcatcacagggttcaatgctcatgcggcatttgcccatgccatcataacggtcggcgccgatccaaaccgtaccgcacagcacttctgccagcttcggtgcaatggatgcatcatcgagcagaatgtagccgtcaaaccgctgtcctgcatcaatgctgcgtgtctgaaagatatttgtcttgtcagcgccgcgttgaatgcgctgactgccgccggtcctcgcgttccaatagtgcagtacgccgttttcaatcgtgcagaacgaaccgacatcggcacgtttggagccttcggaaatttcgccgttctctaaaaccgaacgaaaatcgctgccatccttctgctcataaaaacccttgagggacgggagaaccgccggattgtcattctgcaccggaaatgcgctcaggaagcgcgttttctcggtcagcagtgcaattttattggcggcaaaccagtccggttcacgctgtgcgagcaggctggccgccataccgcgcacagccgcaccggcaatgtatccgtgcgtgtcccagctgttttcaccggaacggttgtagtcggtcatgctgaccggcgtttccgtataaagcgtgtaatgcaggcaatgggtctcgccgaccgtcggaaaggcggttttctgcgattttaccagctctgcggtaacttttacatggccgaagccacggcttcgcatcgtgcccagccacttgatgccgcgcgcggattcccgcacaagagacacatcctgttcctcacagaaaatcctgccggtaaaggtctgtcctctgcaaatacacatcgccgagcgtaatgtacccgttttcacaacatcgttttccaaactggtaaacgtgcggtgatcatagcaggtctcgctctcctccggcttttcttcgagtgtcagcggtgtcaggtgcagacgacggccgcctgccgtacccgtccagccttccttgccgagcagtgcctctactgtatccgtcgggccgccgctccactcgagcagatcctgcatactctcacgcagcaggcccttgaaggtagtacctttgagatacggatagccgttttcgtcctgacggaccgcgatatcctcgccgccgggaatgctgtgtcctgagccgaaaatcgtatcggaaagcagctccaatctgacttgtaattctacctgcttgctcatgcattcccctccagtcgctcaaagtgatccatcatttcgatcgcgtcaaaaaacaggcagtgagaaaccggttcactgtttctgctgccgtcatcaaaggtgcggaacggctgcttgtcgatcgctttgccgtttttcagcatggcggcaaattgggcatactgcttgtctgccgtatcaaactgcgcttcaaatatcgcgcggagcagcttggtgatttcactgtcctgcagcgcatagcggcattccagatcgccctgcttgatggcaccgcgcagttccttgagcttgccgcgcgcaattttttcgccgctttcctgcaccgcctgcttcatctgcatacacataccgcgtacgaaatcataggtgcgtacattcattttcgtgcgcgcagccttgtccattttgccctcgagcaccaccaccggacgtaattccatgcgttttccgtcctcggtctggtagtccgcacgaatctcacggagattttctttcagctgaccaaattcaatatgccaatccatcacagataccgaaccatctccgcagagcgaaacgccgtacttcttggcactgctgcacagcgcctccgccagatcatacgcctgatggaacgggtatttcagatgtaccatagctacgcccgcacaggccgcataggtttcaccgtcctgcggattggtctttgcggaaaggtgcttcataaaccgttcggcacattccagacccagacagccgcgcgcgacaaagcacacatcatcaccggcaagaatgaccggacgcaccggaagaatgccggtgttgcctgcgggattggcggcctcgtaagcggccacctctgccgccatttcccgaaaggctgcttcaaaatcgtgctgaatgccctcgctgaagcagcgcagcttgtcgcagcaggcgtcccagctttcggtttctgaatcatacagattctttacacgcttgcccatcgagttgccgtcaatatgaacgacagcaataaagttctcatcggtcaggccctgcagatctacaaagtccttggcgaatgcccagccttccggcgggtcgattgcgttcggtgcagtaagcgatgcagcttccgatttctgctcgatgccgagcgaggtcagtcggaacgacgcctttcgcagagattttttctgctcgagcgcttcggacagccaaaccagattctgacccggtgtcgccggttttccgttctcgtctgtctcccgatattccatctgcttggcaaacagctcaaggccgtcatactcgcgcatggccttctgcgttacctgctcggcaaagcgtgttgccgttgctctgtccccaaactggaggatggtgtgtccgccgcctgcgtacacaaaattctcacggctgttgtaatattccggtgcagcctgcttgaaaaattcctcgctcgtcacatagcggatgatatccgaacgtgccgcgttatcccttaggtggatgcttgaaaatatataatcctgctttctggaaacctccagaatcaaaagtattttgctcaaggcactgcctcctttcgacatgatttcattatagcacgatttggcaaatgttcaataatattcaacaagttcttgtatgtgtgccccggttttgttgtgcatttcgccctgtttcgggtgaggaaaaagtgaaaacagatatcacctccttcttatgtggattttttatgttacgcagtcagtcgtcggtcgcgatggaaatgatcttcacggccagaccgatcacagccaaaatcgtctgcggcgtcataggtttcacctgccttttcgttggatttgcgcactttctgcggctttagtcatcgtttgcgatgctgatgatctcggctaccagaccgaggatagcgataatgccctgaggcgtcatgcggattcacctgcctttcctgctgtgattcggaatgcctgtccatctatgtatgtatcaccactccctgttccatttcctgaggatttagaacggctcatcggcaaagccgccgataaagccgatgatcgagccgatagcaccgccgacggctgcgcctgccgccgtaccgacttccgcgccgaagaacgtgccgaccggtccgaaaaacgaaccgcctaccgcaccgacaccggcaacgaccgcgccgccgattccggcaccggtggtgccgcccatagccgcacaggatgcgccgttggccatgcgtcttgcaaattcattcatactgcctgcctcccttcctttggattttcagaacgtgtcagttcttgtcgatcgtgtcaatgatctcggctaccagaccgagaatagcgataattgtctgcggcgtcatatatttcacctgccttcgttatgtatttctttcaggagaatcagtcctttgcagtctccacctgctctgcgacgaacttcacagcttcgatcaccatcgcaatcgcggtgatgataacgctcggcttgatatctttcatggtgttttccctcccttcacttagttatcggatttcacacgcggtttttcacacttcccgggaaatttttttgctcactgcgccagacccagactaattgctgcagcctgatcgacccggcccatcatttccacattcaggctgcacagatagcgggataagcgcgttttgtcgatcacgcgaatctgctcgagcagaatgcaggaatttttcagcaggccgctgtccgcaccgcaccagacgtgtgtcggcagcggctttttcgtgcggctgctggtcagcggcgccacaatgacggtcgggctataccggttgcccatatcgttctgcagcacgaccaccggccgttcgccgttctgttcgtagccgacgccgccgtgcaggtcggcgaagaacacctcgccgcggcggattgcggtatgtacgctcaaatgcttcacctctttttccccttctatttctatatcagcggattctcgaccgatttcacacttcacgaaaaattttttcggagaacaggaaaaccgctgttctcctttttgttacagccgccgggtttggagttccagcttgacgatctgctgccagtacaggtgctcgaaggcgatttccggctcggtctgtccgtcagccagatgcagcgtgcggccggtgaacctgcgtccggcgaccgactgcagcaccgggcgttcgtccgcgagcgttaccaactcggcgagcagctccaccggcagtacggcggcgattgcatcggcctgctcgatcagcgggcgcagtacgtccgcctgttttacggtttgggtgtacggcagcacctgcaccgtatcgcccagcacgcgcgcaaggtcgcgcagctgcggttcggtcatggtgtggcgcgatatccataacacggttttcaatttttcacctcccctgctgtggatttaggtctgcttagtagcagatggtgtctttcacccagtcgaggagcggattgtcctcgccgaacagcggaaaatccagccacggctcacggattacaaacatgcggttcacctcccgtcctttctaagtccttctgtataggtatcagaaattttccggcgtttttcacacttcccgaaaaatttttttgagaaggttctttgccttacacaatgttatcggttggagggacggggtttttcacagttcgggcaaaaaaataaaaccgacctgtcaaaattgacagatcggttttttgctgtccccaaaggggtacgaagtgttactctcctttttatctttaaggaggatcaaagatggcaggttgctgtcccccgcaggggcgcgagttgttacgtaaagaaatttacaacaaaccccgagattataaagttgctgtcccccgcaggggcgcgagttgttactgatgactgcggttaccacgaggaatgcacgaaagggttgctgtcccccgcaggggcgcgagttgttacttgaaaaggccgcagctgagtcccaggctcagcaggttgctgtcccccgcaggggcacgagttgttacccgaacgtgaaactctgctgtcgtacgacactgtgttactgtcccccgcaggggcgcgagttgttacggtcgcatcatcggatgcagagcattcggtaaaatgttgctgtcccccgcaggggcgcgagttgttaccatagcatcaacatcctgaacgataataacgaagttgttgctgtcccccgcaggggcgcgagtcgttacagaaagctgatacgttgaactatcaggaaggtcgttgctgtcccccgcaggggcgcgagttgttacatgacctacgcaggcggttatccggaaccctatattgctgtcccccgcaggggcgcgagctgttaccatcgctagctcattggttttaaacaaaatttactctttgctgtcccccgcaggggcgcgagctgttaccatcgctagctcattggttttaaacaaaatttactctttgctgtcccccgcaggggcgcgagctgttacctgattgagatcggcaagtccatctatgagtagttgctgtcccccgcaggggcgcgagttgttacgcgttaacacacagatgatcaaggatgccatcctcgttgctgtcccccgcaggggcgcgagttgttacggcaaaaatgcgaaaaatacaatgcggattttcggcattcctacaatctttttgtattatcttctgtatttttgcgtatccattcgtgatattgtcggttttccttggtgcgaacctacctgtaacaactttatttattgttattataacacgaggttcgcaccaaatcaaccggtctcaaaaccttcaagtttcgccaccggttgcaaaactcagcgtcataaattataatagaggtatcaaaacctatattcaaaactcgcggtgtcaaaaccgtgaaaacggagggattggcatgatattcggctacgcgagagtatccaccaaaacgcaggcgcgcgacggcaacagtctggacgcgcagcaggcggcgctgacggcggcgggcgcggaaaaaatctacacggacacgttcaccggcaccaagatggaccgaccggaatgggacaggctgcgggcgcagctgcggcgcggcgatgtgctgatcgtgacacggctcgaccggctggcgcggtccgtgtcgcaggcgtccggcatgatcaccgacatgatcgacgagggcatcaccatcaacgtattgaacctcggcatcctgtccaacgactcggtcaacacgctgctgcgcaacgtgctgctgtcgtttgcgcagttcgagcgcgacatgatcgtgcagcgcacgcaggagggcaaggcggtcgcgcgcgccaccgacccgaatttccgtgagggccgcccgcccaagttcgacaccgagcagcttgaccatgcaatggctctgcttgaggaccattcctacgcgcaggtcgtcaaactgaccggcatcagcaagtccacgctcatccgggagagaaagcggcggcaggcgtgatgccgcacggcgctatatacaataagatatctgtgcggagcaacgcagacaaaacaaccgagcggctgaaaatgcagtcgctcggttgttttgcgtatgattcagaggtttccgccgtcttgattatttagaccacggaaaccggatcggaacgccatggcaactctgtataatttccccttctgttttccgacaaccagacaaaaagaaaggcactgtgtctaaatcacagtgcctgaggctgtcgaaaaactatcgtttttcgagcagcctctcgatcccataaagtcgttttctcaagccagcatatccgggcgttcgccaatgacctcgcggtatcgaaccggcgatacccccactagacgcttgaacatccggtaaaagtaattgcggttgatcatgccgacccgaccggcaatatcgcccgcactgtcctccgttgtgcggagcagatgctgcgcttccccgatccggcggcgcaccatatactgaatgggcggcaggccgaactgcgccttgaacatatggatcatgtggctggtcgaaatgtgaaaccgattggtcagctcggtcagcgaaagctcctcggcaaagcacaggttcaaatgctgcaatacctcggttgcaagcgagaatgcggcatccggcgcacacagctcgaagccatgcgccataggcgccatctgcatcagcagcgcctccagaagcggtgtccgggcggtagccgtggtctgttccgagtagagcagcagcagaaacatccatgccggtgttccctgtaactgcggaaactcaaacaccgcctgtccgtcattcgcggcggaaaagcccagcatcagacagggtgcctgtacgaacggcagctcgtgacagacattcggcggcagcagcagcgcgccgccgggtttgatcggcagacagaggtgctcggtccgcagaatgatcttctccccgtccgcagcaagcgaaacaaacagcacccaatcctccgaggcgcaaggcagatagttgccgcccttatcctgcggatgaatcacacattgctgtgttagtctgacacggcgaaatgccggaagcaaaacagacataatacctcctgacccggatcaaagtaaattttcgatattgtgtcgcagcagcacccgaatatcggtatggtaaaactccttcggcggctgctgtttgagttgaatgtaatcggccagcagggacagcggcagtgcgccctgctgcaccgcatcctgcccgatgacaaaatccgcaacaccgcgccgaagctcgtacaggttggcggggatctcatcgtgcatgatcaggtgcaccccccgtgcgcggccggaatcgaccagcgcgctgcatgcgcccgcataacccggcgtgatcgcgtagataccggtcagctcgggagtctcctgcagcagacggagcgtatgctcgtaaaccacattgctgtcatcgttcggcagcgtgacctcctgcagctgaagcggcgagtcaggggtaagcagctcctccttaaagcccttcagacgttcgcggtacgcactgtgatacatacagggcgtaatgatcgtagccaccgtgccactctcccgcgtcaccagacgcatcagctcggccaccgtacggccggaagaaatgttttcctgcccgacatagcacagccgacggctgttgggcagatcggtgttaaacgtaacgaccggtattccgcgttggtcgatcagctcgttgattttggtttcgaccagcagacagtcgagcggcgtgatcgccagcgcactgatatgatgctgctcgaccagattctcgatcatcgagacctgttcgaccggatcgagcgagggcgacagccggaagatgacctccacgctgaacgcagccagacggcgggcttcgcgccgggcggcatccagaacgatctgcatgaacggagtctgcaccgaaatcatgatcacgccgatgcgaatcggatgcgatgcgcgggacagtgccagaccggcacggttgggagtgtagccatattcggtggctaccgccttgatccgctccgccaccgcagggcgaacatttcctttattatggagtgcccgatcgactgtaccgcgggacacaccgcaaatctcggcaatttgattcagggtaattgccatatgatatcacctctgtcagaacgggactttcccgtttttatagttaaagcataacataatacccataataagtctatatataaagtgaataaagcggtattcacaatattgtgcacgtgtacggattctgcttattcacgccgtgcacgcaaaaatgcactcttttccgaaccttccgtgttttgttcatattttcatacaatgtgtctgctgtaaacgccgtaaaacgagcaaaacacgagaaatccgaaacgaataccgagttgttatgagattgaaccaacagccagatcctgcatctgaggcgggtagttttgcataagcgattcccccgctctgtcgtgcaaagcttataaaatcacaattttgtgcagacagaatcaccagttttcgcaagattcgtctgtgcgatttggtgaaaattcaaaaatccggttgacgcacatcgaaaaagagtgtaaaactaaatcaaggcaagcgtaaatcgcatttttcaaaaatgtgaacgtgtacggctaagaaaaaagttgagaaagatgaggtaaaagcaaatgaaaaaaagacttttcgcaggattgattgcatcggcaatgatggcatccatgctggcaggctgtggcggtggcgcacagcagggcggcagcgcagacggcggcagcggccacaaggtaacgctgatcatgagccagcgcgatgagtggctcagcgaaatggaggcagccgctcaggccgctgcaaaggacaccggcatcaacctgaccacccaggatgccaacagtgacaccagcaagatgatccagtacatcgaatcctcggttaccgcaggtgaagatgccatcatcatcaacatggtagaccccgagaccgctgcacagtgtatcgaggccgcaggcgatgttccggtcgtattcgtaaaccgtttcccgggcgatccctccgtactgaatgagaaggctgtttacgtcggctccgacgaaatgacctccggcgcattccagggcgagttcctcgcaaagttctttaaggatcagggcaagaccgatatctcctacctgatgctcaacggcatcctcggtcagacctccaccaccaaccgtaccgcatccgtgctcaaggcactggaggacaacggcatcaaggcaaccgcagccgctgctccgctggcagccgattatgaccgtgcaaccgcaatggacatgatctctccgctgctcaagaccaccaagtacgactgcatcatctccaacaacgatgcaatggcactcggtgcagtcgaagcaatgcagcagcagggtctggacccgaagtccgttccgatcgtcggcatcgacgcaaccgctgacggccgtcaggctatcaaggacggcaccctcgctatgaccgtattccagaacgcagagggtcagggccgcgcttccctgcaggcagctgcaaacctgatcgacggcaagccgatcgcagagggcaccggctatgaagtagacgacgagaacgagttcatcatctgggtaccgttcgagccggttaccatcgacaacgtagcagattacgactaaattccgacactgaatgttgcgaaggggacatttccacatgtccccttcctaaaaaaacgcagagatattggggtgaaaagcagtgagtcaagagtatatcctggagatgaccgatatcgtcaaggatttccccggcgtgcgtgcgctgaaaggcgtacagctcaaggtgcgccccggtaccgtacataccctgatgggagaaaacggtgcaggcaaatcaactttgatgaaatgcctgatcggcatccatccgcccacatcgggcaagatcgtttttgacggcaaggaaatccgtttcaaaaccacattggaagcgctgaactccggcatttcgatgatccatcaggaattatcgccggttccggaacgcagtgtcagcgaaaacctctggctgggccgcgcaccgcgcaagggcctgatcattgatcacaagaaaatgcgtcaggacagcatcgacctgttccagcgcctgcatctggatgttgatccggatgaaaagatgggcaacctgacggttgcaaaaatgcagatggttgaaatcgcaaaggcggtttcgtatgacagcaagatcgtaatcatggacgagccgacctcctccctgaccgaaaccgaggttgagcatctgttccgcatcatcgaagaactgaaaaagaagaacgtagcaatcatttatatttcgcataaaatggatgaaattttccgcatttcggatgatatcaccgtatatcgcgacggcgagtacatcgccagcgaccgcgcggaaaacctgaacgtagataaactaattcagcttatggtaggccgtgaggtttccaatatgttccccaaggtggattgcccgatcggagataccattctgaaggtcgagaacctttccgccggtcatgcggtaaagaacgtatcgttcgagctgcaccgcggtgaaattctgggcatggccggtctggtcggcgcaggccgtaccgaaacggcagaggctattttcggtatgcgccatatcaccggcggcaaggtctataaggacggcgaggagctgcacatcaagtcccccgagcacgccatcgcccacaagatcgccctgctgaccgaggaccgacgcggcaacggcattgtcggtatgctgagcatcaaggacaataccgtgcttgccagcctgaaaaactacggtttcccgctcaatcacaagaagatgcgcgaggataccgacgagtatgtgcgtaagctcaataccaaaacaccgacgatcgacacccccatcaagaacctttccggcggtaatcagcagaaggttctggtaggccgctggctgctgaccgatccggacatcctgatcgtagacgagccgacccgcggtatcgacgtaggcgccaaggccgaaatccactcgctgatcaccaagctggccggcgaaggcaaggcgatcatcatgatctcgagcgagctgcccgaagttatgggtatgtccgaccgcatcgtggtcatgcatgaaggcacgatgaccgcaatcgtagatcgcaaggatttctcgtccgagctgatcctgaaatacgctaccagcgaggttccttaccagcccgctgctgatgagaaataagaaagaagggtaaatggtatgcaaaagacgtttgacaagaaaaaattcctgtcgcagaactcgatctggctggtactgatcgctatggtcattatcatgggtgttgcacagcccagtttcttcaccgtaaacaacctgctgacgctgctctccggtgaggccgtcaagggtattctggccttcggcgttatgttcgcgatcctgtccaagggtatcgacctgacgatcggcgcatcggccggcctggttgcctgcatcacggcatctctggttcaaccggcagattatgccaacgcagtattccccggtctgggcaccctgcccgcaccgctggttattctgattggtctggcaatcggcgcaggcatcggcgctatttacggtgcgatcatcgcgtacaccaagattccgcccttcatcgcaacgctcggcgcacagctgatctgccgcgcaagcgcaaaaatgtacaccagccgcccggtttccaccctgtcctcggagttccgtttccttggctctgctaaaatcggctcggttccggttatcattctggtattcttcgttatgtttgcgatctcggccttcctgctgacgcagacccgcttcggcaaaaacgtgtatgccatcggcggcaacgatcaggctgcccgcgttgccggcatcaatgtagaaaagaacctcatcatggtttatgtatggtgctcggtttgtgcggctgttgcaggtattctgctggcaggccgtgcaggttcggctgacccggctaactccggcctgaactacgagctggacgctatcgctgcggctaccgtaggcggcacctcccacaccggcggtatctgccgcgtatccggtgttctggcaggcatcctgatcctcggcgttatcaacaacggcctggttatgctgaaggtcgatgataacatgaccaacatcgtcaagggcctgatcatcgtcggttcggttatccttgatatgcgcaagaacgcaaagcgcgcgtaaaacagacacacacaatctctcttctcttccgagttttcaggggtcgcagcaatgctgcggctcccgaaatactcgcacataatccgttaaacttgaactctgccgtacagcggcatattttgaaaggatgagctttatcatggaaaatctgaacattgcactgatcggctgcggcatgatcggccgtgagcacatcgagcgtatccagaaccgcatccgcggcgcacaggttgtggccgtatgcgacgtatttgaagaaggcgcaaagaagggcgctgagattgccggcgccggcaccaaggtttacaccgatttcaacgaagcaatcaacgatccggacgtaaacgctgttgtagttaccaccccgggtcagttccacaagggtccggttctggcagctatcaaggccggcaagccggtattctccgagaagccgctggctaacaccgctgctgacggcaaggagatcgttgaggccgagatggcaggcggcaagcacctcgtacaggttggcttcatgcgccgttacgaccgcggctaccgtcaggttaaggaactgatcgactccggcaagttcggtgcccccatggtaatcaagtgcacccaccgtgcagacggcgttgccgatgactacaccaccgcaatggctgttaccgataccgcaatccacgagatcgacgttctgccgtggctggtaaacgacgagtgggacgaggttcagtgcatcatgccgaagaccaacagcaaggttaagaacgcgctgaaggacccgcagatcatgattatgaagaccaagggcggcatcatcaacatgctcgaggtaaacgtaaactgcggcttcggctacgacatcaactgcgaggttgtatgtgagaacggcgttgtaaacctgccgtgcccgtccttcccgaccgttcgctacgctaacgaggtttccaccaagatcgaggacaactggatcctgcgcttcatcgattcttacgatgtagagattcaggactgggttgaccacgcactcaagggtgagaccggcggctcctctgcctgggacggctacgttgcttccatcaccgctgacgctctggttaagtcccagacctccggtgtgccggagaaggtcgttaccggcggcaccccggacttctacaagaagtaatccacctcatattttctattcattgctactcactcgcaagggtggcagagcttcctgctttactgcccttgcatatcaccttaaccactataccgcgttttacaacgcgaaattgatacgttaaaaggagttactgctatgaaaatcggttttaacgaaggctgcaaccgtttctgcgaaaaccactccgtacttgaagacctcgacctgtgcgagaagtacggctttgactacatcgacatccagtccgagtgcctcgaccgcgagatcgctgccggcaagtacaccatcgatgatctcggcgcttggttcgctgacccgaagcatcacctgaagatgctgtcctacaacgccctgatcttcttcaacatgaagcagacccaggaggaaaaggatgccgttatggcaaagctcgaccagatcatcgcagactgcaacaagctgggctgcaagatgatcgttgttgtaccgtccatggacttgaccgttccggctaccgttgacgagatcaaggctgatgctgttgcagtcctcaaggagatggtaaagaaggttgagccgcacggcatcaagctgtccatcgagttctgcggctgcccgaccatgtccatcaaccgcttcgagtacgcttacgacatcgttactgaggtagatcatccgctcgtcggcatcaccctcgaccagtatcatttccatgcaatggcttcttctttcgaggctctcgagaaggccgacggcaagaagattttcgtatggcacctgaacggcatggagaatatgccgtgcggcgctgcttacaacaacgacgagaagcgcctgtggccgggcgagccgggcgactgcctggatcacaagcgttacgctgacaccctgaagaagatcggctttgagggcgatgtctgcaccatggaagttttccgtccggactactacaagctgtccagcgaggagaatatcaagaaggccgctgaggttaccaaggcacatgttgcaaagtactgggctaactaagttcatagcgtgaagattgaagattgaagagtggagagtgaagagctttccactctttttttgcgtggaagcccctggtgttttcggtaaaataaaagtcgagcaaaagaactccaaaatgtgagaccccgatggcacaaaaaatgatccattgtcagcacccccaataacagctaccattagtttgtgttcaataaactaaggaggtagcagaaaggtgttaagaatggaccgcgtcaagtaaagttcacaacaaggctcctgaaaaatgaagttaggctgcggtggtcagtgttgccgcaatggattcctgaccgagataggctctggagacagaccagtcctcagcgtattccatgagatacgttgtccccaggcgaacataggaactttcattcagaaagattccgaccacactggtacgtctccgaatttcacgattcaatcttccaatccgtcttcaaggcactgaaccgctttcggaaagcggttggcgtaggagtcgatcacatcgcagcgctgccatgaggctccggaaaaggactcacggattgttgaagccatcaagcagtgcgcctgccgccggaatacttccgaccgccataacagccgccatggcaatggagatcagtctttttttcattttcataccccttatcctgtttcgtgtcaatgtaaattcattatatcctatccatgtattgaatgcaatgcgaatagtaaatagtaggaaactgtggtataatcaggttatattcagggctttcgtccaaaaggggagaaaaagtatgaacaggcatgaaaatcaaacgatgaaaatattcggcaaacggctgaccgctggtctgctgggtgcagcactggtgatgagcatgccgtttgcagccgcactgacacagaagaacatcacggttggacgcggtgtaacgatttatgtggatgaccggaagatcaatccgggtgacgcaaacggcaatccggtagagccaatgctgtataatggtacgacttatctgccgattcgcgcggtatctgcggcgctcaatgtgccgatcgcatgggatggaacgacgtccagtgcgtatctcggcgagcataaggtagaccagaatgcggtaaaccgtgcaaaagcgtatgtttcggtgatcgagcagctgcagagcaagtacggcaagcgcgctgtcagcggcagtattataagcggtctggtgacggctatgctgattgatttcgatggtaacggaaacgaagaactgctttgcgtttgcaatacgaaggagaaaaacgctaagggaacgaataagcacagtacctatatggtttatcactgggatggcagtaaagcaaattgcattgcacagcacgaggtaattagtcctttttctcagaatgatccggattatttcaagagaaccattaatattggtgaacgcgatggtaaaaagtacctgttttgggaagccaatggctccacagtcggagaagatgatgtcggtcttatcagtctggttgaaaccgtagttgacgggcaatggaaagtcacttggggtttacgagaaaatgaggactggggagataatggaccggttgtgtggatgacggactacacaactggcgaaaatatagatgtaagtgcaggctgggctgaactgaacacatggcaggacgacataaaaaaccaatataatgtaaccgctgacggtccagatgcatggaatatgtgtaacccttatgataacctggctcccgcaccggaaatcgcactttccaagctgaaagccatcgccaactcgcagtcgtccattctgggcggcaaggcttcgagcgaatacaccgccaaacgccggacagaaaagctgaccgttcagaccggtattaaggtctatgtgaacgacaagcagattgtcccgaccgacgtcaacggcaagacggttgacgtgttgctttacaagggcacgacctatctgccggtccgcgccgttgccaatgcactcgatcaggctgttgcgtgggatggcgcgagctacagcgtatacatcggcagtcacaaggacgtataagtttcaggagatctctgtatgccctcagaggtagaatggacagtcagtgatccgactgtagtaacctacgatccagtaaatggcgctgtcagttcggcgagccgaaaaaataaaggagcctccatcgccatgcgtggaagctcctttggggtaaagtagggtgatatgattttcaacaactgagatctgaaaaacaaacaggaggagtcggatattggtttatccggtcatgaagattgggtaaatacacgccgatcgctggagcggtttcatacctgctgtctcagacagtgtattcacgtatcacaggcttgcggcaatattccaaataacctgcagggcattcttcaccgcgagtaatacgtttcgtacgtcctcctctttatcgcgatatgccatgtcgcgacaatccttaatcgttccgtcgatgggatcaaatcccatcgtccagatgtcagtataaggactgtccacggaaatggatctctcaatgccaacctgattcaggctgaaaaactgattgggcgccagtgctttcatgcgttcatatacaccgtatccatttgcaccgttggcttcggtaaacgtcaggagcagcgttgtcagggcatattccatcgttgctgctgcacgttcattgcccagttcacgcgcccgtttgttcaatggcttaatcagtgtcatgtacggcagcacgctgccgagcagctcaccgccattctctttcgcgatagctggcagatattctgccgcatattccaaaagcgcataaactgcgtttacatccgcttccgtgcagccgagctgttcagccttttccagcagagctgccagcagaatcaccatagattttacgccgttctccggcagagtacctgtcgacagcactgcaagcgcctttgacgcttcaacatcttccggactggcgttttttacgatctctcccatggacatcgtaagcttacaggtgcctgcggcatcccggtattgaatccactttccattgccataagcacaggcggcaatatctctcagcttgaacagtccgcttttcagcgactgctctgctgtcatcgtgcggggcattcgtttcagcataatattaactgtgtctcctttcctgagtttacggttctacattcgttctgcgcagttcatcctgcacttcgtgaatatctaattccagcggctttttgttctgcgcaacacacatcgcggcaacaatacccatagcatgccccatattcattacaatcggcataacacgatagctggagtgcgccttatgcgtacccgaaatattgcgtccgttcagcagaataccttccaccgtctttggtacaaagcagcgcagtgggatcgtatacggcttcggctgcttgaacgccttgtattcaccattggcatccagtccggcgccttctacattgtgcagatcaaagaagaaattcgacttggtaactacccagtcttcaaaggtacgagcctgcgcaatatcctgctcattcagctgataattcgcctcaaaccggcgggtttcacgcacaccgatcacatcggcgctgtcgatcagataacagccctcatatcccggcacatggcggcgcagaaatgcaataatctcgggaagctgctttctgcatacgtattcagcacgattcagatctcttgcatttgtgccgtccacatcggtcatattgctcatgttgaccgtaacaacgcctgggagcgacgaaggatacagcaggatatgacctgccggagagggtaattcctgacgaccgagtgtttgcagatcgccttccggcagctggaccgtatcctcaaagccccagaagaacatggcgcgatccatatctacgccggcaaccttgaacatgatcgtcatcggctgcataccgccgtccgtcgaacgtcccttttcaaacggaacgcccgcacgtgcggccacatcgccgtcgccggtcgaatcgatcaccattttgctcaggatcgcttcccggccggatttgctctctgtgattacacccgcaacgcggtttccatccataatgacatcgctgaagcctgtgtacagctgtacattaacgccggcctccatcagcatatccagcatcagaatacgcagtttttccggattgatgacctgctccgcttcacagtcgcgtgccttttcgcgcagctcttcaaagcagccgccgtcctgtctgccggtccaatgactcataatgcctgtggttgccacgccgccgatcgcgccgtattgctcgatcagcatcgtttttcgtcccatgcgtgctgcgtgcagggcggcgccgaaacctgcggggccgccacctacaacaaggacttccgtttctgccgcaaccgggatctcccggctcggctcagtatagtacttcatctgaaactcctttttaatttaactctgttttttgcttttttctgtcctttgctgccttgtagaagaacattccaatcgaaagcacagccagcgcaaggaacaacaggctgaacggccgtgttacgaagatggacagagaattgccggacattaccatcgagttgcggaaattcgtttccaccagatcaccaagaactacgccgaggatgatcggtacaacaccgaatccaagcttgcgcagcaggaacgaaaatgcgccgatgatgaccgccagaagtacctgaaatgtgctggcttcgctcgaatagacgccggtaatgcagtaaacaatgatgattgcgctcatcagctcataaggaatgcgtgtgatattggcatacagcggggtaaacacacgaccgataatcagcatcaggatattgataacgacaagaccaatcataatgccgtacagaatatcgctgtgctccttgaacatggagggaccgggcaccatgccttgcagcataaatgcacccagaagaattgccgtacaaccgtcaccgggcacgcccagtgttgtaagcggaatcaatgtagaaccggtcgttgcattattggcagactcggttgcggaaacgccttcgatctcgccgtgaccgaaatgatcacggtatttggaggtctttttcgcctgatcgtagctgataaaggctgcaatgccgccgcctgtacccgggatagcacccacaatcgtaccaatcaccgaagagatcgtcattgttttgaggcagcgcttgatctctgcccatgacagcttctcatggtccagcttcaaatgctgcttacgcgttgcatctgtacgcggattataatccgagtggctgagcaattcggcaattgcgaacagaccgaccagcgtaacgatcagcgggataccggcgcccagtcgacgaataccaaaggtaaaccgaagcgtaccgctgaccgaatcctgtcccagcagtgcaatgaaaataccgatcaggccgccgagcagacccttgatgatattgccgttcgagatgcttgcaataatagacaatccaaacactgcgatgcagaaatactccggagggccaaacatctgtgtgaaatgtgcaatgctcggtgcagcaaacagcaataccagcgcactgaacaggccaccgaaaaacgaggcatacagcgccatcgtcagagccttcagcggcttgccctgctgcgtcagtggataaccatccagcacagtcgctgcgctcgagggcgtacccggtgtattgatcaaaattgcagtaatggagccgccgtatgtgccgccgcaatacaagccaagcagcagaagcatcgccgggatcggttccatactgtatgtaatcggcaggcacaggatgatcgcaatatccgcagtcagacccggaatggcaccgataatgatacctgccagcagaccgatgaaaattgcaatgaagctctctgccgaggccatcagcgccaaaccggtcatcaagttgtttaacatatgcgcttcctccttcttatggcagagtcacgctcattgcctgaaatgcaaagtacgcaacgattacatttgcactggcaatcgcatagaaccaccattttctcgtaccgaaatacagcagaatgccattggaaagcagcagcgaggaaatgatgaatccaatatgcggaagcagcagcgcgtatgcgatcagcatggcaatatagattaccggtttcagccgcagcagattttctttggtgaaaatggctcctgaaatcgtgtattcggtcttttccttggacaggataccctgcaccagcaagatcacgctgcaaagtatcatgccgcggatcagaagcgtcggaactgttgcagcagtcaccgcgctggtttcaaacgtccggatctgcgatggtatcagaatatgcagggcaacagaaacgatcagaaacagaacgcctgttatcatattcgaatttagctttactttcaatcttgtcacctctcacaccagattaaaaggcaataccgcataattttcgcaaagcaccgcggcagtgcgaccggagcctgcacaaggagccgcggcagcgcgaccggagcctgcgcaaggagccgccgctttcattgtgcggtattgccttaaacagaccagcctgttacttgagcatctccacgtatttgtccatgctgtccatctgatcctcgataaacttcgtcacttcgtcacccttggcatcccacagcggataacccatctcgtccataaaaccggtgaacttggaatcggcatatacgtcatcgagcattgcattcagtttgtctacaatctcctgcggaacgtccgagcgaacagccagacagtccatgccggcaaattcaacatcaacacccaagtccttgatggactttacttcaccgtacggagtctgaaccgtttccggatagaaagttgcgaccgcctggaccgtaccctcttcctgatgcgagtagtatgccggaggcgtacccagaccgcagtctacctgaccggaaaccactgcattgatcgattctgcctcgctgcccataacgaccggctctgcttcgataccaagcgacttgaacattgcagaagaaacaacgtactggtcaccgcccgggccggaggaagttgcatacgtgatcttatgcgttttgccgtagttgatcagatcatcaaacgtcttcatgccggatttctgcggattagtgaggatcatcagcgcaacctgacgcataccgcgcagcatagtgaaatcagaaagctcataggatacatcgatgtacttcggagtcagcgaaaataacggaccgttggcgacgaccatagtataaccgtccgcatccgcatccatggcatccatcatgccgatggtgccggaagcgcctgtgtgattttctacaatgatcggctgatcaaaataattcttggccacctccgagatcttgcgggagatgacatcggcaccgccgccgacgccccacggacaaatgattgttaccggaccattcgggtaatcatccgcacttgccgcagcaccgccgccctttgcattggcaccgccgcagcccgtcagacctgccagcagcaaggatcccgccatcagcatagccatcaatttcttccctttcattttcttttccttctttctttttataattgaaacgctttttcgcgtttgcatacgtattcatttgcggagaataaaagaactattctcctgctgagggacagaatgtgtctcggatgatcaatttgctgtccagtatatatcggtaggtatccggcagtttgttcgatgccattgccatgacccattctactgttaaattgataatcctgtcataatctactgccacagtggttaaatgcggcgtaaaccagctgcccatcgggatattatccgaaccaatcagagccacatcatccggcacctgaatgccctgctcgcgcagtgcttccagcgcgcctaatgccatcatatcgttctgcgcaaaacacgctgtacccggctggaacagttcaatatgctccaaaacctgctgcgtagcctgcttcaggttgtaatctgcatgcagaatgtgcgtatctggcagcttatgcccatgctgatgcaaaacacgtgcaaaagcttcatgtttatgtataacgtcgattcgatcctgcggtccgataatttccacaaatcgtgtgtagccagcttcgcaaaacgccttgccgaccagaccgccaatctgtgaatggctcggtgcgatcatatacgactcatccagtgattcattcgtatcgtaaatatagataaatggaatttttgtttcatgcagtaggcttttgactcgctcatccacctgcggtcggttaaagatcagggcatcaaaccgtcgattgctgatactcttctcgatggaaaaaaactcaccgtatttcccttcatcgaacaccggcaccagatccagcccttcctttacgagctgcatacgtatgcgatagtaaatgtcactttgaatataatggtttgcaaagccggtaaaatcctctgagaatacatatccgatcacaccggtgcggttggtttttaacccccgtgcgttagtgttaaactgaaaggagtattcttccgccagctttttgactcttgccttggtttcttctgaaaccagcggactgtcattcaggcaacgggaaaccgttgattgcgacacaccagctaatttagcaagttcgacggaagtaatcgttttcaactgttttcacctctttgcatacgtatgaattgcttgtcttatatatagcatatttgcaaaataaacacaatagccaaacgaaaatttgcaattatttcgttagtattatccaaattcttatagctgtttttagtactcttgctcttactgaaacccgatcggaccctgttcgagcttcaggagcacttttcccttacggcagcaaaaatcaactgatctccacacctgccgctgcccaataaacccgaagcacagactgctttttcagtctgtgctccgggttttgtttattgagaagaaaaggtgtggtatagtctgacaagcaacggatttgctggtgcaaatccagcttgacgggtggaatccccgtgccccccgtttttttcagccgcacggcagttttacaagagggacggaaacgtgctgcttactccatccatgggtcgataacgaccttcatgctttcacggcctcctctgcctgcgccagcgggaagtgatggctgaacagacgctcccacgggaaggtatccttgtgacgcagcatcatttccatcacggttttgtatttattgtgcgtgtggttcgtcatgccgacgatacgcaacttgcgcggattgagataaacggccacagtatactctcacttttatcgcctgtattgccggtaaattgtccatatatcctgtatttcataacagaatttcagtataaagttaaaaagttaaaaagtcacaaagctataactttgtgactttttaactttaatatttccggaagttacgcaaaaaactgatcgagtgcctgccgtaccagctcggacatatcgcagtcgcggtggaaggctgccgccttgagctgcttatgctgctccgggcgcagacgcacggtcacctgcacggtggaggctttcttcttctccgcagtcggcgcggcagcggtttcctgtgccggctgcggctcctcgtccttgcggccgatcatattcttgaacatttcctctgcgctgagtcttgccattactgttccctctccttctccacaaactccttgacgaaattcagacagtcattcacaaaattccggctggcctcggaaacgcgctcgcccttggtctgtgccttgctctcgatgtagtcaaacacgttctcctgcacagcctgcgcttccttgatgatcacgttgctgcggatggtcgtgcggtaaacatccgcgcccatgtagtccgcgatcttttcggtcagctcctgaatggtctttgtgacgcgggtgcgctcggtgcgcgtgagcagcacgccgtcgatcctgagtgccggattggtgtatttcttcaccgacttgtaagtatcatacagctgggtgatgccggacgccgcaaaggtctccgccatggtcgggatgagcagatagtcggcagccgtcagcgcgttcacggtcagcaggccaagcgacggcggacagtcgatgagaatgtaatcgtattcttccgcaacgccggtctgctcgtcgcgcagcttctcgcggagcgtcatctctttgccgacgttgtgcagctcctgctcaatgcccgcaaggatggtgttcgccggaatgatatcgcagctgggcgtgtgctggatggcctctcgcgccgagaccgtgcccttcatgacctcgtacatagttgcgctgtcctgattttcggcagctaccgacatcgacaggttgccctgcgggtcgcagtcgatcgtcagcacgctgaagccctgctttttcagaccggccgccagaatgccggtcgttgtggttttcgccacgccgcctttctggttggccagtgcaaatatcgcagacatgttctccacctctttcaactttataaagttataactgtttaacgttactcttattatatacctgtgcagttataacgtcaagactgtgtaactttataacgttatctctttctataagttcagagattcgttcagatcgtgtatttctcactcttttctctcctgttctgtcaggaagattgagtagtgaagtttgagtaaagaagttttagtaggtaaggattttagtatatcagcctgttttgcatctgctcaaaaagcatcttgtctttcagcatactgcctgtaaacagagtaccctgtaaaatcagggtaatggtatggcagacaaagaaaaatgacggcttttctgccgtcatcggtgtttggggatgaaaatatgattttccgggcacaaccataagccatgaggtcaatcatggcttaaaaggttattcggtttcctgcgagtggcgttttgcttttacgcgctcgagccactccagttcccagtcggccagcggctgctcgggtgttgtctcggcaggggaggcgtccgtgctgcactgcttttcgaggaagtcgaacagcgcggtctgtaagtatgcaaccgggttgtcgatgcggccgaagtcgatcgtgacgctgttcaggaagcgttccatgctttcctgagaaataaggcgggagatctgctcgcgatgctcctgcgtgaccgcagtgcccttgatgaacagcttgtctgcgtacttgatgttgcagactgccgtcacgaccgttccggtcagctcgctgccgaactgacggcggagtgcgtcggcgttgatctgctgctcgatctgcttgcgcagcctgcggcggacggcacgcggcttgtcctttttgttaacgcatacgtttttacggatgcgggaaacctgcgttttgatcttcgcaaggaagccgtcgatcgtggctacggtggagacagagccgtcgatgtggtaattggtcaggtacggcgtttccagatcgggcgtctcgcaaagcttatattcgtaggtccagtgattctcctgaccggaagggaaacggtgctgcttgagcagaccggaaatcttgaagcgcttccagagtgtcgagaaatgtttcactttctccatgcagaacgcgcggattccctcgggacggagaacgaagtcgggaatcttcatcagatggctgacgagggcgaacagtcccttgctggcaagggaaatggtcttgtcgcgcagaaccgaggtggaaatgttggtgtagtcgcgctgcgcaccggaaatgcaggcaacatcaccgttcgggcggtcgatggacggggaatagacgaagtccaccggctcggacgggtgctgcatcaggttgtagacatgacagaacgcaccattttccgcctgggagaaatagtgctgcaggtatcccttttgcttgagctccttccacgccgcattcagcaggtaggcgctgtccgagcaggcatagccgagacggcgcttgctgagcgcgaaatccggcaggccgacaaaagacttgatgacggcaaacagacccttcgcctcgagagaaagcgttctgtcgcgcagaacttcgttgtagattgtggtgtagccggctgcggacattgctttccctcctttctgatggtcgatttttgcagaagaaacaaaaaatcgtctgatgctctcacaccagacgattgaaaaaccatgtctaaattcgtatcaaaaatcgaaaattcgtaatgttgcacaagtaaaatgtgccgtgttaagcagaaaaattgatttttgtcgaaaaacgcgcgtcttattgacataaccgcttgttgaatgtataatgattatacagtaagcggtatgcgccatttggcgcgttactggtctcaggctagtgagatcttaccgcccgctggtgttggtcgcaccaagtggcggataccgtttatcaaagagctgatgtttcctaggcatcggctcttttgtttttcctgtaattaagaataccatggaaaataaggaatgtcaatcttaatcaggtgaagttgaaaaatactcggaagagttgggttttttagaatgaatccgggttttccggatatacttgcaatgccgcctgatatgcggtataatatcagtaaacgaatgatgagattgttcactgagcacacgaaaagccccggaggtcacgactccggggcttttctattccgttttggagcaggtggcttaggcctgaggctggctaccagttacatcttgccgtccagccatttgcaaatgtagtatgcggctacacttgccagaacggagataaaaaacgatgagataacgctcactaagtacaccccctttttctacctgtataggggtggtagcctgtacagtataacatggatgtcggattgcagcaaggaaagccgaatataggtacagtaggggagcagatgtttgacttcccggaataagactttctgattcggatatacttgcaaagcctactgatatgcggtatactatcagtaggccaaaagatgagagtgtccatactggacacaaaaatcccccagagacgcaacctctgggggattttctattccgttttgtagcaggtggcttaggcctgaggctggctaccgattatttatctccgtccaaccatttacagatgtaattggcgattacacctgccacaacagagataacaaaagatgagagaatttccatactggaacacccccttcctctacctgtatgggggtggtagcctgtacagtataccatggatgtcggattgcagcaaggaatgtcgaatatggttgcaatgattgcggctatgcagtatacttttaataagaaatggtgaaagtgtccatggggcacgaggaaagctccggtgtttctgcaccggagcttttctatttgggtaagactacataaagttataaagttacaaatttataactgttcaacgctaaaactttgaattgagagtctattagaagaaaaggttctcttttcacaatataaccgaaaggaacagcgaaatggtacaaagatcggtttgcctatgcgacggaaaatacatcggcattgagagtattttcacagtcattgacggaaagcagatcaatattccggacaagctgtccgcgcttcgcactagaagccgcaaaggtgagctgttttgtccatgcggctgcggtgcaaaccttattctcgttgctggagacagaaacctgcgcgcacagcatttccgtctgaaggacagcgccagacagcacgagtgcactgctgagaccgagagatcgcactcaatctattccaagatcgtgctgaaatgctggctggatgaaaagctgaacgtgtccgatgtggaaacgcgggttcccatctgtctggtcggagacacggcgcggaaatacgagttttcatttgtgtcgcggacgagcaaacttgcggttagttacagctgtaaccgcgcgaatctgtcagacgagaagatggaaattctccgtgcgaacagcagcggtattcgattgatttatattgttgatgcgttgaacagctgtggcaacggtcagtatccggaagcattgatgaaagtgcaggagcggcagggatattgtctgctgctggacgtcgaggagatggagtattccacggcgaagctgtctgcggttttctacgcgcaggactgtaccggtctgtggcgtgagatcgagtttgcagcaggcgcgctgcgtgaattttcgatcagcgagtacggacggctgctctatcaaaacgcgccgctggctgctctgtgtgaatggaaaaaaagcgagtttgagcgcgaggtacagcaggaaaaaatacggcgagaacagcagatgaaagagctgcttgagcgtccagagcgcgagcaaaagcagcggccaaaacgaacgcagacgctgccggtccgcagaccgcagaatacgaaaagtgagcggcagcgcgcgatggaaaaactggttcacgagaaggaagaggccggccgccgcgcgcagaaaaaacagagagaagaagcgtttcggcagacgcttgcggagcagctttatcagcaggaaacgcaggtcattgacccggacggaaaccgctgggttaaatgccggtactgcggccgggtggacaaaacgacagcgttttcgtcttatggtggacgcggcagtgtgaacctcggaacctgcaaaatctgtgatcggaagcctgtatcggagcgccggtttattcagaaatagagtatcgtacctgtgaaaatttttcacggtctgcagcagcagttagagaagaaaaaagcaagaaaacagcatctgtatggcaaacagaaatgtgctttactatactaaaggttaaagattccgcaagcataaggttttggatagccacaaacctgtttcctcagtggaatttcccctgaaaccccgaatagccacgacaaggagaaaatgaaaaatgagaaaacgcaatcatcagatcattgtgcgtttggatgatgaagaactgctcatgttaaagagaaaaatccacatttccaagccgattaacatagaggaattaatcgatactatcactaaatacattgtataacaaaaaccgcaggatgacttctcaaagaatgccatcctgcggttttactctcataacgcagaacaacacaagccgaaacgcttttccgatgcaagaaaaaatctcccgctgccgggcagtgggagatttcgtttctgttttggcgattgctgtcgatcagaggcgctttacagctcctccagctttgccagacgggaaagcgcttcttcggtaagctgttcgcccggcttgagttctccggtcagaatcgcttcgcgcagcatctgataggctttatccgaaaaagactcccttttcttgagtgcctgtaaagccattctactactcctttgcttaattcaatgtataagaatacatttagaatcgtcaagtataatatatgccaaactagaaatgcatcgcagtctaacgttatagcgttatgacattataactttgtagcttttcaacgttataactgtataaaatatcctgcgtatcgccccatccaagcggctgatcgaggaaatgccggtcagctgtgagcagccgcagataagaaagagaccgtttgcgcggcatggatcaagcgccgcgcgtatatcccatttttattctgaggagtgcaaaatccggcttccttgcgaagatcaaaacgcaggtttcccgcatccgtaaaaacgtgtgtgttaacaaaaaggacaagccgcgtgccgtccgccgcaggctgcgcaggcagatcgagcagcagatcaacgccgacgcactccgccgtcagttcggcagcgagctgaccggaacggtcgtaacggcagtctgcaacatcaagtacgcagacaagctgttcatcaagggcgctgcggtcacgcaggagcatcgcgagcagatctcccgccgtatttctcaggaaagcatggaacgcttcctgaacagcgtcacgatcgacttcggccgcatcgacaacccggttgcatacttacagacttccctgtatacctaccatcagaagctgctgcagccttcgcaggccgagccagtcagcaccggcacatccgagcagccgctggccgactgggaactggagtggctcaagcgcgtaaaagcaaaacgccattcgcaggaaaccgaataaccttttaagccatgattgacctcatggcttatggttgtgcccgtaaaatcatatttccatccccaaacaccgatgacggcagaaaagccgtcatttttctttgtctgccataccattaccctgattttacagggtactctgtttacaggcagtatgctgaaagacaagatgctttttgagcagatgcaaaacaggctgatatattaaaatccttacctactaaaacttctttattcaaactttactactcaatcttcctgacagaacaggagagaaaagagtgagaaatacacgatctgaacgaatctctgaacttatagaaagagataacgttataaagttacacagtcttgacgttataactgcacaggtatataataagagtaacgttaaacagttataactttataaagttgaaagaggtggagaacatgtctgcgatatttgcactggccaaccagaaaggcggcgtggcgaaaaccacaacgaccggcattctggcggccggtctgaaaaagcagggcttcagcgtgctgacgatcgactgcgacccgcagggcaacctgtcgatgtcggtagctgccgagaatcaggacagcgcgaccatgtacgaggtcatgaagggcacagtctcggcgcgagaggccatccagcacacacccagctgcgatatcattccggcgaacaccatccttgcgggaattgagcaggagctgcacaacgtcggcaaagagatgacgctcagagagaagctgcgcgacgagcagaccggcgtagcggaagcgtacgattacattctcatcgactgtccgccgtcgcttggcctgctgaccgtgaacgcactgacggctgccgactatctgctcattccgaccatggcggagacctttgcggcgtccggcatcacccagctgtatgatacttacaagtcggtgaagaaatacaccaatccggcgctcaggatcgacggcgtgctgctcacgcgcaccgagcgtacccgcgtcaccaagaccattcaggagctgaccgagaagatcgcggactacatgggcgcggatgtttaccgcacgaccatccgcagcaacgtgatcatcaaggaagcgcaggcggtgcaggagaacgtgttcgactacattgagagcaaggcacagaccaagggtgagcgcgtttccgaggccagccggaattttgtgaatgactgtctgaatttcgtcaaggagtttgtggagaaggagagggaacagtaatggcaagactcagtgcagaggaaatgttcaagaatatgatcggccgcaaggacgaggagccgcagccggcacaggaaaccgctgccgcgccgactgcggagaagaagaaagcctccaccgtgcaggtgaccgtgcgtctgcgcccggagcagcataagcagctcaaggcggcagcctttcaccgcgactgcgatatgtccgagctggtacggcaggcactcgatcagttttttgcgtaacgttgtaaagctgtaacgttagaactttatatgcaagaaattccgacaaaataaggcgcattttgtcggaattttgtattttataaaatatttatctaaataaaagttataactttacaacgttataaagttatatactattgatttacagcgtcacatccaccttccatctcatacgttagaacgatttatattcggattagacggatagaatatagggtatggttccgaggagatttatgtatttgcttagactcaaactgtagacgagatagcggtcagttaacactctcggtatttgaagcggtaagcgatttggcatctgacagcggggcgtttaccatcaacccgaccgctctcactgtgacgccgaaccagcactgcaccagagcgcagattatgacgtttctatatcggctgtaaggcagcaaataagtaatgaaaaaaggagaaactgcggttgcagtttctctttttttctataccgatcagagcgtaaagttataaagttacaacatcacaaagttacagtttttcactctgctcacccgccagataccgtttgagcagaaacgcgcaaaagtacgggaacgtataaatatcgtcactgaacccgatattcccggcggtaaatttgatgccatagtgaatatcctcatacttatcactggtgatgagcgtgcgcagagactttgccgtacctctctgggccttgacctcgaccggaatgagcgcggatgccgtgcggacaaagaaatcctgctcgagcgtggaatcctcgcgcttgtagtaatacagctgatacccggccttgacgagcgcttcaccgactacattctcatacagcgcacccttgtacacgccgaggtttttgttggcgcgcaagtcctcctgcgcctcctcatcgagcatggcaacgagcaggccgctgtccgcaaaatacagcttgtactttgtctcatcataattgcccttgagcggcagttccgggaaattcaggcagtagcagatgttgaccatgccggcatcgttcagccattcaatgcagccgcggtaatcgcggaaacgcgcaccggacgcgaccttggaaatctggaatttcttgttgtccttggcaagctgcaccgggatgtgctgaaacacgttcaaaatgcgggtctggtccaagccgtccgcgtatttgcggatgtcctccctgtagtccgcgataagctggcgctgggtttcgagtgagccttcaaacgtgcccttttcgatgaactcgcggacaacggcgggcatgccgccgagaatgcagtagttgaggaacagctcgccgcagaccgacatttccagttcgttgaacggcgtcagcgtgcgcatgtgtgtcagcatatcgtcaataaaggcatcgtcgtagccgccggcccacaaaaattcctcaaagtccagtgagaacatttcgtaatcggtcttgtagccgacactgttgctctcaattttacggtagttgagaccgagcatggaaccgctgcaaatgacgtcgaaccggccgtcgatcttgaagaatttgagcgcggtcgcaatgtcgggaaactcctgcagttcgtcaaagaaaatcagggtttcgccctcaataaaccgcttagacgggtcgatacgcgagatatttttgatgatatccgccgctttatagccgtctgcggtgatcattttgtactttggctcctccacgaagttgatcgtgataacgctcgtgtagttctctgcagcgaagcgctgaatggattcggtcttgccgacctgccgcggccctttgacgataagcggctttttatccggatttgctttccattccgacagaaaagcgtcgattttgcgttttagataaagcattggggttcacctcttatgagggtattataccccgacagagaagattgcatatagtgaaggaatatcggaggaagaggcgtataatcggtatttgaaatacagaccgagagatgagcggttgcaggagcaggcaaaacagatggtttttgcagagagcgaggtcgatgcaggtttgctggctgggtgtgctgcgaacggtatccgagagatcagcgttatgccggacgatgagtacatgaactatttagcgacagattgcgttgacgctttgttcccaccgaagaacggaaatcagataaaataaatatcgcaaagcacttgcaatgcaaataataatagcgtatactgtaagcagaaaatataggcgatacatttttgagaggagtgttttcacatggcaactaagggaaatatgacgttgcgcattgagccggagctgaagaaagaagcagcggcgttatttcagtcgcttggattggacttgagcaccgctacgggtattttctatcgtcaggcattgcgttatcatggtctgccgtttgagattcgtctggatgagccgaacgccgagacgagagaggctattgatgaagtccagagaatgaagaaagatcctgcaatcggcaaaacttacactgatgttgatgccatgatgaaggagttgctggcatgaagtacagtgtacgcccgaccacgaaatttcagaaagatctgaaacgagtgcagcggagaggatatgatttgtctttgctgacggacatcatcaaaaaactcgcggaaggtgaaaccctgccagagaggaacaaggatcaccgtttggctggcgattattctggttgcagggaatgtcatatcacgccagactggttgctgatctatgaggtggcagacggcgagttgttcctttatctcaccagaacggggacgcacagcgacttgttctaagaggagtggtgtgccggatggcaaagacgatcaaggaaattgcggcagaatgtaaggtgtctgaacaggcaattcgcgggtggtgtcggcgaaaccatgttgcgaaagatgcgaaaggaagtttcgcaattagcgaaagccaaaaacgcaagctatatctacactatttgggggtagcgcgaaacgaagttgcgaaacctgcgaaagcaagttgcgaaacttgcgaaacctctgaaacagtgctgatttcaatgttgcagaaagaattagaccgcaaggacgcgcagctttctgcgaaagacgagcagatcagagagttaaacgcgaggttggctgagtgcagcactgcattgttggcagcgcaggaaactgcgcgtgcggcgcaggccctccacgctgggacaatccagcagcagctttccgatggggaagatcgtgtagcggccagtgtgcctgaggagcaggctgcaccgaataagcggcgctggttcaatcggttctttcggagataatggctgtaagcaatgataataagccctggtgtagcacaaaacgccagggcttttgctgtatgtgttttggacatttagagtggttgatatttacatattttaatggagattgtattataataggtgaaatttagagaattgcatgagatgcaatctataattgctcaaatgcaatcgtagattggtttattttagtcgaatatgtgggtaatatagaggtgtaataaatgactacagcagagaagttagttagcttgagaaaggagaaaggtttatctcagcttcagctggctgaggagattaatgtatctcgtcaggctatatcaaggtgggaagtcggattagccgttccctctcgggagaaactcagagcattgagtgagctgtataatgtatccgtggattatttgctatcggataaaacggctgaagatatgcaaaaagtttctaaaccggaagatgaagcaaaagaaaaaccgtcaaaccatttacgggtgggcctaatggcttgcgttgtagttatattgctggttgtggtgggtgttatgctgctgcatttacataacactaataagccgcaaaatgaaattccaatttccgaaatggaaacagaagaagatgatgttgtattttctggagatttttcggtagattggtaggcgtttgtgaaaggaagtggtagcaatgggagttaagaaaattttcggctctattttggcaggagtgctcatcgttagcggggtgggtatgtcagctaatgcagctgatattgctccgaaaaacgttgagcatcgagatcgtgtaattgaacagagtcttgaacgtgcttcagggtcctttaatatgacggttcctgctaaatctatcttgcgggcagataagagtttcccgttggaagcaggggaaactgtaacgattaaagctacatactttccattctctgcaagcgtagattttggtttggttgatagcaaagggaaatttcattatttaaccgtgaataatggcacttttgataagaccattaaggttgatactcgtggcaattatgtatttgcagtgagaaacaattcctcacagagtatttcggttagtggttatgtaaaatactgagtttatagactatagaggtgtctttatgaaaaaaaagcgaattggaataattgcgttaatgctttcaagtgcgctcatcatttctgcatcggctaccattagcactgctttcaagtgctcggcggcgggaattgattatcaggcatattcgacattaaatacgtcaagcactgcacctaataaattagctggaggaggaacagtagcaactgtaagcaaaaatactgtgccagctggctatatgatgattaagtctacaattatgacttcgaagggtgaagtagtaggcagctctagttggactcaaaatacacaatatgcgaataatttggtttctaacattagctatgcttcttatggaacaggaacatattacggacaagcccttctgaaactttacgaaggtggagagtataaaccactgacagttaccagaactccatcaatggcaaagccaactcgttcgtctatggcgaataataatcaggaaacacaagataaagatgctattttcgtaaatgagaatggctatacaatgggtaatgccactactgaagattcttctgagattagagatttagatttttattccgctattggtgtcaatggtaaaaaaggatatattcgagcaagtgaaatgaatgggccgaaaacgcttgatgaagccgcgacttatgacgatagcagtaaagatattcctgtatatgcatctgatggtgtcacggtcattgatactttccatatttatggacccgaagaaagttcctcgactgatactatggttgcagctacttcgttaacggaataaattacaaattttaagattaggtaaaatagcatagaaaggagcatttttatgaggtctaagaagaatatgattaaacgtttagtatcgttgctgttatgtagtgctatttgcgttgttgcggcagctgcagcagataattggcagtattctaaatggacagcaaccgtgacgggtgtaagcaatattaaatatcatggaagaacagcgataactgcttctaagggattggttcgttctacagcgacaattttgagtactaatacttcagcgttgccggcaggatatgttaaggctaaagcagaactatatcgcggaccggcattagcttcgtatggtggacctgtatcgaattccgcatcgagtacaggcgttactgcaagcacgggacaagcaagtggtgcgggaacttataccgcgcagggaactacatattatgcgacaagtagtaatagggatatggagactcttgaactggaaagtgtagattacaaaacgttggttcgagctaatggcggaaagaatttaaccagcgaacaaaaagagattcatacgaattctgctggagaaacttacggggaagcaatggttgtaaagtatctgaaagcagatgtagatctcatttctgccgttggaaaaaatggagtagagggctacattaaaacatcggatcttccgcataatattccggattatgttccgtatgaccatgagattccgatctatgaaaatgatggagttactgtgattgattcgtttttcatttcttctggatatgcaaactaggtagaatagtcagagtattgaatgtgtgacaaatagaaagaagctcttgatgggcttctttctatttgtataagttgattactgtgtttttttcctatctgtaaagagaaacagggcggtgattactatgctgcctatatcgtacattccgaaaaacgagcgtcaagggtggttcacacaaaccacttttttctacccgttgtacgccgatctgctgcgcagacggctcgaacggggcgaaaaaagcaagcccttgacgctcgtttttctccatgtgccgcagcaggcagaaggataatctgctgcactggggcttgctaccgcaagcccatctcccacacttgacaacgatatgccagatatgtataatgagggtgtgtgagatatattgcaagctacctaaagtgttaccactttagagcttgtgagggggctgcacccccttcaatcccctgattggagaacgccgcgaacgaaagaaagagaggtttcccatgttgtacgaagatcggaaaaaagaaatcgaaaccatcaaggaacggacactcgttttgaaattgtccgatgctgattgcgaccgcattttgcaaaaagcagccagccacggcatgacggtttctgagttgttggagagcttcatcagtgatctggtcgatggtactttcaccaatggttcggacgaacgctatcttgctgaggattggttcaaccgctgcggttttgagcgtgatgataagagaacgctgctgtggcatttgctggagcagaacgcagacctcgaaaattttatcgaactctatgaggagaacgaagaatacaaatcgcacccagaggagtttgaggagcagcgtgaagaatacgaaatggagccgggagcaacgttctggtttgaggaagaattgcagtattgtctggacgattggaagccgagcaagttgagcatggccgaagaagtagaagctgtccgcggctatgtacaggcaatgaaaaacttcaagggagaataactgcggtggcaaataagagtagaccgaagcagctctcattccgagttagtgaggaggaatgggagctgctgcaacagaaaatttctgaaagcggtatgaaccagcaaaggtatattttatcctgtgtattggggaagaaaatcgtgaatacagacggcattttagccatcatgccagaattaagacggcaaggcgtgaacctaaatcagattgctcaaagacttaatgagcgtggttatattgactataaaaaagaactgtcaacagtactgaatgaggtgaataatgtatggcggttattaaagccgtatcttccagagctggaataaagacaattcttaattatgtgatgaaagaagaaaaaacagagaaaaagttacttagttgcttaaattgcacaccagacatggttcaagaacaaatggaatttacaaaacgtctatgggggaaaaatggtgggcgaacgtataaacattttgttcaaagttttgcaccggaggaaaatatagatccggtgcaggcgcaccagatcgcgtgccagttggcggcttcacgcccagagtggcaggactttgaggtgctgattgccacccacgaggacaagaagcacatacatacgcatttcgtagtgaacagcgtgagttgcgtagacggccacaagattcagcagagcaaggcggagctacaggccatgaaagattattctgaccagctgtgtgcgaaatatgggctgcatattaccgaaaagggaaagacctttgacggacaagagcgagaggaaacggcagcattcagcaaggacacatatcagttgctcataaaggccgagcagggagaagtaaaaagctacgtgcaggacattgcgctggcaatactgaagtgtcgagaacaagcgaccagtcgcgccgattttgtgcagcatatgaatgagcaagggtatggtgtggattggcaagatagccataaatacattacctttatagacttaaatcgccaagtaaaaggtgaaaaacagtgcaaaattcgcaataataagctggaaaaatactataatatgaatttcggaaaggagacattggagcatgagtttgcaagcaatgcacgaacagcagaaacgccaagagagcagttcaatcgaacggcttcaagcggagaattcgagactttcatcgcaaatcttgcgcttacagagcgagctgcagcagcgaagtcaagagatagtgtcgctcaacgagaagatcgggaacatcgagcaagagagcagctcgcagcttgtcgaagagcagatgaaggagatcgagagacagaaaaagatcaacgcggagttagagaagatagcagaagacgcctcgaaagagatagagggattggaaaaggaaaacgaaagacaactgaaaaccataaaagaagcagcagagacattcttgaaatatagtaacctatacaaaaaattagtgccatgcgaagtgatgggcttaatagatagggtgaacaatctcgaagtagaggctacgatctttggcggtgtcaaaggcttgaagatggaacagtgggaaaaaataaaagagagcgtcaaaagcatatcagaagctttgagccaagatccgatactaaaaaaagaaatggaaaatcaaatgaaaatcattgatccaccaaagggtatacgtgcaagaattgcagagaatgaaaataataaaaggaagtgatacgaatggatgaaatgacaaccgcagagcgcaaccagtatcttgagaacatcgccaagctgattgaaacgaccgcagaggacgctgcctctgccgcacagattgtgcgtgacagcatggcgtcagaggaagatactgaggaattggatgagatgacaggcaaagagattgccaggctgatggaatggctgaaagcccatgggcatacatcggacgagatcgtctcctgcgtcgagtacaccgttacttgaggtaaaggactcccgagggattaggctttcctcgggagtcctttattcgtccagagacttgacgctgtgcgcggtatgagatacactaagaacaggcgaaaatggtcgaatgagcgcccgctttttttgtcgggaaatggtgaaaaaaaattcattgataatataacgcccctaatagggggcgaggggatggtagagggtagctggatcggagtcggactaccttgaaaattcgggcaagtagcgtgcccaattttttgtcgggaaatggtgaaaaaaaattcattgataatataacgcccctaataggggggcgaggggtctggaggagaatggtatgtttgatattgtagcggcgttggagtcgcagtttgacgaggtgcattacttagatttttatcgggatatcttcccggaaggctcgttcgaggagcgcggtgtctatgaggacgggaagtacaatggtattgccgttaccatttcgaaaggtagcaagcgagcaaaacgcctgacagttaccgatgatcttgacgcgattactgatatggcagcgtccgatgatttttgtttaatgagccctataagctatgtcggaaagagtcgaaaatcctcgaatgctcggtttatgtacgcaatgaccatagatttggatgggttagagagcttgatacagtggcagcagcttatggatcagattgctcgggagcctggtgtgctggtaggaggttggggattgccacgtccgacctatctcatttcatcggggacaggacttcacctgtactatgtctttgaaaagccgatcccgatgtttaagaacattgtggaacagttagagaagttgaaaaagcgtattacttggcaggcttggacgcagggcgcgtcatcattgcatgacaaggtgcagtatgagagcctgtttcagggtttccgcgtggttggtacgattacgaaagacggtggtcgctgccgcgcgttctcagtagggaggaaggtgacggttgagtatctgaaccagtttgttccggaagagtatcgagcaacaaatttcgtttataagtcggatttgcggttggaagacgcgaagaagaagtatccggagtggtatcagcgacgtgttgtagaaaagcgtccaaagaatacatggacatgcaagaaggcgttgtacgattggtggattggaaaaatctatgggggtgctgaccagggacatcggtattggtgtattatgacgcttgcgacatatgccagtaagtgtggtgtaccgcgagaaacgctcgagaatgacgcatacgggcttattccttttatgaatacaaaaggtgatgcctttaccgaagacgatgttctgcacgctctggaggcttatacggacagctatattacatatccgattgatacgattgtcgtgcggacaggtattcctattgagaagaataagcggaatggtagaaaacaagccgatcatgttaaactgatgaattttatacgcgatgagattaacggtaataaaaattggcgtgaaggcaatggtagacccagcaaacaggatattgtagaagaatggcaatgccagaacccaaatggcactaaaaagcagtgtaaagatcaaacggggctatcgtatccaacaattcgtaaatggtggctggatcatagcgaaatatttcctttgtatggggaaggtgatgaaattattagatatgtgaccaaaagaattgtggaggagtacaaccggttaggtgtgaaaacaagaggggagaataagcgtatggatatgacattggcacagcaggcagcagaattgagaaagtttacgaggacaggggcaatgctgagcttatcagagtccgagcggcgtgaaaaggcgcaggaactgatggatttagctgaaaagattgcatatagtgaaggaatatcggaggaagaggcgtataatcggtatttgaaatacagaccgagagatgagcggttgcaggagcaggcaaaacagatggtttttgcagagagcgaggtcgatgcaggtttgctggctgggtgtgctgcgaacggtatccgagagatcagcgttatgccggacgatgagtacatgaactatttagcgacagattgcgttgacgctttgttcccaccgaagaacggaaatcagataaaataaatatcgcaaagcacttgcaatgcaaataataatagcgtatactgtaagcagaaaatataggcgatacatttttgagaggagtgttttcacatggcaactaagggaaatatgacgttgcgcattgagccggagctgaagaaagaagcagcggcgttatttcagtcgcttggattggacttgagcaccgctacgggtattttctatcgtcaggcattgcgttatcatggtctgccgtttgagattcgtctggatgagccgaacgccgagacgagagaggctattgatgaagtccagagaatgaagaaagatcctgcaatcggcaaaacttacactgatgttgatgccatgatgaaggagttgctggcatgaagtacagtgtacgcccgaccacgaaatttcagaaagatctgaaacgagtgcagcggagaggatatgatttgtctttgctgacggacatcatcaaaaaactcgcggaaggtgaaaccctgccagagaggaacaaggatcaccgtttggctggcgattattctggttgcagggaatgtcatatcacgccagactggttgctgatctatgaggtggcagacggcgagttgttcctttatctcaccagaacggggacgcacagcgacttgttctaagaggagtggtgtgccggatggcaaagacgatcaaggaaattgcggcagaatgtaaggtgtctgaacaggcaattcgcgggtggtgtcggcgaaaccatgttgcgaaagatgcgaaaggaagtttcgcaattagcgaaagccaaaaacgcaagctatatctacactatttgggggtagcgcgaaacgaagttgcgaaacctgcgaaagcaagttgcgaaacttgcgaaacctctgaaacagtgctgatttcaatgttgcagaaagaattagaccgcaaggacgcgcagctttctgcgaaagacgagcagatcagagagttaaacgcgaggttggctgagtgcagcactgcattgttggcagcgcaggaaactgcgcgtgcggcgcaggccctccacgctgggacaatccagcagcagctttccgatggggaagatcgtgtagcggccagtgtgcctgaggagcaggctgcaccgaataagcggcgctggttcaatcggttctttcggagataatggctgtaagcaatgataataagccctggtgtagcacaaaacgccagggcttttgctgtatgtgttttggacatttagagtggttgatatttacatattttaatggagattgtattataataggtgaaatttagagaattgcatgagatgcaatctataattgctcaaatgcaatcgtagattggtttattttagtcgaatatgtgggtaatatagaggtgtaataaatgactacagcagagaagttagttagcttgagaaaggagaaaggtttatctcagcttcagctggctgaggagattaatgtatctcgtcaggctatatcaaggtgggaagtcggattagccgttccctctcgggagaaactcagagcattgagtgagctgtataatgtatccgtggattatttgctatcggataaaacggctgaagatatgcaaaaagtttctaaaccggaagatgaagcaaaagaaaaaccgtcaaaccatttacgggtgggcctaatggcttgcgttgtagttatattgctggttgtggtgggtgttatgctgctgcatttacataacactaataagccgcaaaatgaaattccaatttccgaaatggaaacagaagaagatgatgttgtattttctggagatttttcggtagattggtaggcgtttgtgaaaggaagtggtagcaatgggagttaagaaaattttcggctctattttggcaggagtgctcatcgttagcggggtgggtatgtcagctaatgcagctgatattgctccgaaaaacgttgagcatcgagatcgtgtaattgaacagagtcttgaacgtgcttcagggtcctttaatatgacggttcctgctaaatctatcttgcgggcagataagagtttcccgttggaagcaggggaaactgtaacgattaaagctacatactttccattctctgcaagcgtagattttggtttggttgatagcaaagggaaatttcattatttaaccgtgaataatggcacttttgataagaccattaaggttgatactcgtggcaattatgtatttgcagtgagaaacaattcctcacagagtatttcggttagtggttatgtaaaat
